United States Patent 9,328,346 (POLYCOMB-ASSOCIATED NON-CODING RNAS) - sequence listing, part 148

SEQ ID NO: 192430 - RNA, 78417 nt, Homo sapiens
uuaguggaagaguaaauuaauuuuauugacugaugaaaaacuaaagugauaagaaguauggauaguagacaaccacugaauucugcuggaauucucuauuucuucuuuuucacuuuaagccaaaagaaauaaaauuauagaccauuagggagcuaguugcuuuuaguuccuucaagaaaaacugcauaguuuagcaguugcacagcauuaaauauauacaacuuugcaaaauccuggaaguuuuaaacuuuguguugacuucaaaggcuaauguaaucaccuacacuggucggauucagaguuucuuuucccuuuucugccacccuguaaaaaaaaaaaaaaauagggaaaauuauuuacaacauaccauuuugggaccacuucauuuaaaaaauauagaccaaaggcaucuugggguaugagaaggaagcaauuucuuuuuugauuuuguuguaaauuugagucuacauacuguuacauuauuuuaauaugguuauuuuuuauaaaugguuaagguugguuuuagaaaaguuacuucuauuugaauaagagucuugccuuaguaagcucaccgauaucuuauuuuuuuagaacucauuuugacuguucuagaauuaaaaauaaaguuuuugaucaauacuaaaauaaacaguacacuuaaauuuguuccauaugaucagcaaauuuaguaauucaguucauuaccuuuuggguaauucaauuuauaauucaaguucuguugcguuuugcucacauuagcauuagaaauuugauuuuguucauuaguggauugaaaacuagguuaugcuuuucauauugcuuaguugcauauauaaauuuguauuuaauuugcuccauaugaaacaucauuugugguauuugacuugagccaaagcaaaggaaaggcagcauaaaggacaagaaggguuuuacauaaauauuuuaacauaacauaacauaacauaacauuuucuguuuuauucugauuuaaaaaacauucauuauagaaauauggaaaguacaaacaugcaaagaauaaaauuaaaaucaucaauagcuacucuacccccuucaauuuaaccauaaauaaugguuuaauguauuuacuuuauaauaguuguauguauaguuuuucccauuuuuauaaaacuauggcaaugguguccaaacuuaguugaucaucagaauuaccuaagcaguaauauuuuuagaauucugacaucuaggcuuugucccacaccuauuuaauuggcuaacaaucuuuaauucaaaguuuccaagugauuccaaugaucagccaaguuugggaacuaccuuuucuguggaagugcaucucuuaaagagaggugguuguaucaggggcauauggagcucagacucauuugauaaugauggcaguuucucuuuguuucuuucauucuuuuucugacuauaauaaccauuucaacaucaacauuauaaaacaaaaugaaacaauacucgcacauaagaaugcugucauucacuccugaccauauaaaaauuuugccaauauuuauucagagaaaaacaguaugaauagguuuuuuggaacaggagauguguaaugacauguauuaaaaacaagauuuauuuccaguuagcagaaaaauaaaaauaaacuuagcaaaaauauuuuuugaaauagauacccacccacuauacauaaaacuccuaccaugcuucucgaugagauuucuuaaaaauccaaaacaacaaacacacaagaaucuuuucaagguaucccagguaaagggaauucucuuucuaggacugauucaauuuuaaagccacggcuaaucaacugcuauguucuccacaccaugaguggcuuuugagauuuuuuggcuaugauuccaguuaauguauuuuauauuaugauuuagaaacacauauauauacacacacauaaauauaucucucacacacacacacacacacacacacacacacaaaagcacugguauuuuuaauugcuucauccuggaacaaacugcucaaugcuagcuuguaaaugcagaagaaaugauagaguuagaaaaucacuauuuugcaaucacaaaaaaaggcacaaauaucaauggaugcuaaagccacuagaugaaaaggguauucauacaaucuuaaaguaucaccucacauauuaauuauaaaagggaaaauauauauuuacaauggagauaucuaggagauaucacuguauccaagugaucaaccuuauaaacaggacaauuguccuuuugugccuuuccccaauaugauucaauggcauguaugcuguaucaucuauguaguaccaagaauuuuccugaauuaugcuaguuauugcuguauauaccaaugucuagaauaacaucuucuacauuguaaauuauaugaccgauaauaaaauuaucaauauauuuagugaauaaauuuuggccuaagaauaaaauacugcauuuauucucacacaguaucuacuccaaauguauuauuugugauaaaaacacuuauaaauuauaaaagcauaccugguauuuggcuaacucugcuuguaauacuuucacuuuagaucuuucuuguucuaaugcagcaugaagugaagucaccuauaaccaaauauucaauaagaaaaagaauuuuugggguuuuuggcaaauacucaauucuuaacauauucacaaugauagguuuuugacagcuaaauggaugaguaacagagaagcuccccccauaauuuccauuugguauuguacacagcucuauguuaaagauggggcaaacuguccugagagaagaagacaauaaggaugugaaggggagaaaaaucaagcccagauacaggguuaaguucuauuggcccuuucugucucuaaauucaugguucauuaaaauacagccuuaucauccccuauucuucagggggaaggacauaccuaccucuuuuagugcuguaaacagaaucuucauucaugggcuauuacauaauaauaaaguauaauuuauacuacauccuuacaguguugaugagcuguauuuguuaaguuuaauaauucaagacuaaagacagcuuaagaaaaccagucauguaugcuccacaguuccuuaccugaauagugagcucauucuugauacuuugugauucaucaacuugcagaaguauuucugccuuaucuuucacugacaaaaaaggaaaaacagcaguauagauuuuccagucacccaaauacuucaacaauacuucagggaacuaagacauagcagugcaauuagaacaaugauuucuugucauacuuaaagaaucuacuucuugaccuugcauagcucuuacuuuucacugguaaauucuuuuuuguuuguuuguuuuacauuuucaccaguaaauucugaucaucaucagcacagcauuuuuuucuuagaaauuuuacauuuucugugguguuaaaauauuuauugcugggcaugguggcucacaccuauaaucccagcacuuugggaggccaaggugggcagaucacuugaagccagaaguuggagaccagccuggccaacauggcaaaacccugucucuacuaaaaaauauuauacaaaaauuauccaggugugguggcgcaugccuguaaucccaacuacuuggaaggcugaggcauaaggaucccuucaacuggggagguggugguugcugugagccaagauggugccacugcacuccagccugggcgacagagagagacucugucaauaaaaaaauacauauuuuuuaauugcacaaauauggugcaagauuaauuuuuauaucuacucuaaauaggacaaggauacaagaaaacaaaauuucacauauggaaaaaacuuuauaaauaccuugacuaaucuuaaggcaugauuuuaaaaacaauuaugguagcucacaccuguaauccuagcacuuugggaggcugaggcaggcagaucaccugaggucagggguucaaaaucagccuggccaacauggcaaaauccugucccuaguaaaaacacaaaaauuagccagguaugguggcacauucuuguaaucccagcuacucgggaggcugaggcaggagaaucacuucaacccaugaggcggaggcugcaguaagccaagcucacgccacuggacuccagccugggugacagagugagauucgucucaaaauaaauaaauaaaaacaaugcagagugcuuuuuuuguugaauuguuggggguggugagcauaccauaaugccaacaaaauuauauuucucugaauaaauuuucauaccaauaaggcaaugucaacuaaauguagcucauaugaucacaaaugaucauaugacauguguggucucuuagaacuauucauuuuuuucuagaggcuucucucucuugggagaagcgagguaucuauacuuuggcccuauguuuccuaagcuucagaaauuuucacauggcugagaacuuccuuaacucaugguaacggcuaauguaugaaaaacuaacuccucacuuugaaaacaaacuaggagagacuagagagguaaaauuguaauaaaauuagcaaaggaggaaaaugacuacugauaucaccacagcucugccaauguaagauuguaguucaaauucauuuucauaguuuaauaugauaagaugaaacacccuaucaagaaucaauucagucucucaagaaucaaccugggaacuuuuacaaauuaugcuuucuacuccuccauccccaggauuauaaacacuugcugaaaacuagugauuuuaaagaguuauguaauauuucaauuacaaucaguucuccuauaaugcuuguuuugaaaacacaaauuuguuucaaugagguugauguauuagguaacaacuugaacauaacacaaauuuucaauacacuuauguacaauuuuaugaacagagaaaaccacacccacauguacuccuugaauaucuaccagcuaccuugguucacuguguguuaggaaacacacccaucuggucugacaacuuuccauccuuccaccaugcagcaguaacacacaagcuauaacccuucugagaccuacuuccccacaagcaaacuucagguuuucuucaagguaaagugccauauuuauguaauauuuauguauuuaaccauuuuaacauguguaaaacugcguuacuguuuuuauuaguuucccaucuuuuuuucaugugucacugacaacgauuuuaagugcugugcuucuaaccuuccuuuuucucguaaguauuguggggauuuuuuguuucuuugagacagguguauuaguucauucucacacuacuauaaagaacugccugagaauggguaauuuauaaagaaaagagguuuaauugacuaauaguuccauauggcugggaggccucaggaaacuuacaaucauaguagaaggcacugcuucacaagguggcaggagagagaauaagugcugagcaaagggggaagccucuuauaacaccaucagaucucaugagaacucacuaacaugagaauagcaugggggaaagcacccccaugauucaauuaucuccaucuggucccacccuugacaacuggggauuauuacaauucaaggugagauuuggguggagacacagagccaaaccauaucaacagggucucacucuguugcccaggcuggagugcaguggcaggauuacagcagucucagccuccugggcucaugcaauccucccaccuuagccuuccaagcagcugggaccauaggcgugcaccaccaugccaggauaauuuuuguacauauaauuuuugagacaagguuuugucauguugcccaggcuggucccaaacuccugggcucaagcgauccaccugucucaaccucccaaagcugggauuacaggugugagccacugugccuggccaucuugugugauuuugcagagacuagugauuuuuaggaacacaugcugcauuauuacagaacugaccauauuuacauuuacauuauaaguguuacaaguauuuucauguaaugauccuauauaaaauucuacuuggauuacuuaugcuauggacacuguuguuacugauagcgauuuuuaaucuauuuuugagagcaagcuuuuaucaguuaacuuucucaauuuccacaguguuuuauggggaggaaauauuauuuuauuuuuacauauuuagaauuuauacauccaauacgcaaugauacucuucauuucugcacuuagaaauauaucuucuaaauaacuuaauuuuuuauuuucauaacuuuguucauuaaaagacccacauggagaucaauaacaugcacaggucuaaauuaaucucaggauguagacaucuaaauguccaaauaauauuuuuccccguauuuuuuuuuuuuugagacaaagucucacucuaucagccaggauggagugcaguggcaugaucuuggcucauugcaaccucugccuccuguguucaagugauucuugcacuucagccucccaaguagcugggauuauaggcaagcaccaccacaccuggcuaauuuuuguauuuuuaguagagauaggguuucaccauguuguccaggguggucucgaacuccuaaccucaagugauccaccugccucggccucccaaagugcugggauuauaggcaugagccacugcgccuggccuccccccauaauucuuuaacuucuauuuguguaauaguuaaguuauaaaaaauauaagguugaaccuacuucaagaguauucauguucuguucaacuggacaugauuucugauuuuuacucauuguuugacaacuauuuuguaauguaguuuaaauuuuguuuggacaguuauauuccaaguauagucaucccuugguauacaauugcuugcaggacaucccgaggacaccaaaaucuaaagaugcuuaagucccuacuauaaaaugguguauauuugcauaaaaccuaugcauauccuucuauaugcuuuaaaucaucucuagauuacuagcugggcgugguggcucaugccuguaaucccaacacuuugggaggccgaggcggguggaucacgaggucaggagauaaagaccauccuggccaacauggugaaaccccgucucuaguaaaaauacaaaaaaauuagccagacgugguagcaggcgccuguagucccagcuacuugggaggcugaggcaggagaacagugugaaccugggaggcggagcuugcagugagcgccaccacacuccagccugggcaacagagaaagacuccuucucaaaaaauaaauaaauaaauaaauaacaauuuaaaaaaaucaccucuagauuaccuauaauaccuaauauggcauaaaugcuauguaaauaguuguuacacuguuauuguuuagggaguaaugacaagaaaaaagucugcacauguacaauuucaacaaauauauuugugauccacaauugauugauccacagauggggaacccauggauauggagggcugacuauaucuucacaucugaaaaccauuuuugguauuuuguuuuuucauuuuucaaggugaauuucacaauuucuuaagagcuauacaauauucacaggagcuaucuuuggaguuucauuagcauuuauuaacaggaaaacuguugauuaauuuugucuauucagagaaagauuuucuccuuuaugucuuaaucuguguuucuuuugugguuuauaauuuccuuugccuaagucucauacuaaaaaauuaacauauauuucuuuuucuauuaugaauggaaaauuuucauaaaacuuucaagauaaaugucacuagguauauacacagugagaaaugcaacugauuuggcaggcuuuuguauaucagcuuuacuaaucuuaucaucugcaaucauuuuuuucuauugauuuccuuggcuuccugcugguaaccucuugucaaaaguuuacagaguagcagcaaaaguaugaagagcaguggggaggggagaaggaaauaaggaaacaaaaaggaaaaccuaaagugaugacaggcugccuccuucaauaacugaaaaagcagaauccuaagcaaauguuaggcuuguuuucccucuaaauauaguucaguaaguuauaagaauugaaauuuuaagaguuucuuuuaccugaauaguuauaaacugguauaaaacuaaggugcuguaagagugaccuguaauaauaacuuuaucagcaacuauccagcauuuuuuuuuuuuuuugagacagucuugcucuguuccccaggcugcaaguacaguggugcaaucucggcucacugcaaccucugccuccugaguucaaacaauucucaugccucaguuucccgagcagcugggauuacaggugugcacuaccacaccuggcuacuuuucguauuuuuaguagagaugugguuucaccauguuggccaggcuggucucaaacuccuggccucaagugaucugcccaccuuggccucccaaagugcuaggauuacaggugagccaccaugcuuggccaacuauguagcuuauaucacucugggaaaccuuucuacuuuguugagucuuuuuuucaauuuuuuuuauuggcacauaauaaucauauauauuuaugaggugcaugugauauuuugauacaggcauacaaaguguacugaucaaauagguauuuaagauauccaggaacucaaacauuuaucauuucuuuguguugaaggcacuucaaaucuuuucuucuagguauuuugaaauauacaaauuauuguuaacuauagucacccuauugugcuaucaaacacuuuuguugaguugguaaaucacacauuugaaaaaguaccuucagauauuauuuaagauaaacuuuuaauuacaaaaacauaaaauccacuuacuuucaccuuccugaagcauuuucaauaauugugcauuucuugccuuuacuuccuuauacuuugccuaauagucaaagaaaaaagauuuaguuuuuuuaaaaguaagugauauaauuaaugauuuacugucaacuuacagagcucugaauucuuggcuugcucaaagauauaauuacuuuagaaacaaacaggauggaggaaaauguauucggaacuaucuacaacuuaaauuaagucccuggcacaauaauacauaucaauauuauacgugauugaaaauuaaaggagagagggauaaaaguggagaaaacucaagauaauacuaaauuuuccuaaauaaucuucuuuucuuccucagauaaaacccuuauacaauucaaaauaauuuaaaugaaaaccaaaagaaaaaugagccacaguucuaaagcaguacugucuggcaauauacuaggacuuucuacaucugcucuguauuugucacuguccaauaugcgacuacugaaagaacacuagcaauguggcuagugugacugagaaaaaugaauuuuuaauuuuaaacuuuaauuuuaaauuuaaaaugugauagacuuguaguggauauugaauuuuauaggacaguucuauaccuucucaguugaagauucacuaaucguuuguuauuucacuaacuaaauaaucacuguuauaauuuuuggcuggcaugaauuaguacuuuacccaaauaucuuucaacucuuuuucaauuucuuuuuccagauggcuuagcuucuucucacauuacaaaaaugauacaaguauacauuuaugaacaaaaaggauuguguucccacauuaacauccauauuuuaggcaauuuuaccccaugcuacccuuauuaaacaugucuuauaacacucucuguaucacuuauuuauuuacuuuuuuuuuuuuuuuuuugagauggagucucacucugucgcccaggcuggagugcaguagcacgaucucggcuuacugcaaccuucgccuccuggguucaagugauuuuccugccucagccucccuagcagcugguacuacaggugugugccaccaugacuggcuaauuuuuguauuuucaguacagaugggguuuuaccacguuggccaggcuggucuugaacucuugaccucaagugaucaacccgccuuggccuccccaaagugcugggauuacaggcgugagccacugcgcccaagccugaaucauuuauaaagauuuaauacauuaauacauuagagaaaacaaagcauuuaacacaguauagaaaaacaaaacccuaaagaaaacauuaauauaagaaaaaucauuuuuuuccucucaacauauacauagauauguauagaaguuaccagauucaaauuuuuuaaaaacaaauuaaaauguguuuuaaguccaauaaagauggcuuuuacuaaauaguacucuguccauuaaauuguugaugauaaguaaauaauguuuacugaguaauacugcagugaauacaauaaacugaaguaaagcaccauacugaauauaaacguagaaagacugcugagaagcucagaaaugaacaagggagaccagucaaauggaaacauaaaaauauaaugggggaaaacacauacacucaacuacaacuauauucgcuaugaauauagaaauauucauugugaauaugaaacuacacucgcuaugaaauucccacccucugggcuccaaccuauguuaguauuucaccaaacucuaucucuggcucaagccuuuguucaagguccagaucagucuucauggagguaccucuuauucaagguuuacggucuaaaauagcucauaaagcaaaaauugcaaaugagcaugauuaccugugacaauuauuugcauugcuuaaaaacugcauauauaaaaauauaaauguacaaaauaccaguaacauauuagcuaauaaagagcacauaugaaauacauaacauucuugcuagcauauuuaauuucaugacagacagcauacaaaguugauaaaauuaaauacacguguuguuacugcacugucuaaaaaaguagccauuuaaaacgcaacauauccaaaaugaaaucuauuaguucccauuccccaaaucagucaaagacgugcucuuccucuuacacucuauacuuauccauuguuuuagcagacugucuucacuccaagccucagcaacaugcaucaucaucgcaaauaucuucucaauaucaucccacagcagcugcgucauuuuacauucccaccagcagugaacauguuccaauuucucgacauccuugccagcacuuguuauguauacauuuuauuuuaaaccucaaaucuuaccuccucccuuaggcuuuuuaaaaaaucuauuuuuuaaucuauuauucaucucaaguauucuucuuugacuaauauuaauucauguaaaaauuacuuauucaaugcuuguaacgugccagcuacuuaauaauuaucaugucacuuaccuucuaaagauuuuuaaugcccucucuauuuuauuucauuuauuuuuucgagauggagucucacucugucacccaggcuggagugcauggcacgaucuuagcucacugcaaccuccaccuuccagguucgagcgauucuccugccucagcauuccaaguagcugggacuacaggcgcgugccaccaagcccggcuaauuuuucauauuuuuaguagagacaggguuucaccauguuagccaggauggucuugaucuccugaccucgugauccgccugccccggccucccaaagugcuggaauuaacaggugugagccaccaugcccggccuaaagaccucucuaaaauccaaaugccuucaaauucugaacccaacucauaucugcaauuucaacuucuaguuucccauuucucugaaugucagccacaauguaccuuccuuccaucauauucccaugccuuuguacauacaauucucucuaccuggaaaaaucaucuuuucuaugagaucuuuaccaauuuuugauagcagcaacucauucauuccuuugucuguucuucuggagcauucugucauauccuacauuguacugcaacuauuuacauguuuaucuuccccauuaaucuacaagcuucuugcuaacucaucuuuguauucucugugucuaguacaaaaaaaagcgaagagaaauguaaaugaaaagcuaagguaaaugagugggugcagucaaaaaaaguuuuaguagggaugauucuuaaaggcaugaguagaagaagaagggaaauguaagaaccaucagggcuggaacuugauuuauuuuuuuucacuaccacauacacagggcgcaaaaaguaucuggcacauuacaggcacucaauaaauaauuguugagugaauucauauuagucaaaaaggaaugauacuugauaugaauaacagauuuaaaaaauagauuaaaaaaaaaaaaaccuaaggggagagguaagauuuguaguuaaaaauacauuguauacaucacaagugcuggaaaggauguggagaaacuggaaccuuuguucacuccuggugggaauguaaaaugacacaggugccauggaaguuuggcaguuccucgaaaaguuaaauguggaauuauauaauccagcaauuccacucuuagguauguacauacccaaaagaacugaaagcaaggacucagauacuuaugcaccaguaaacaaaauauauacacacaaugaaaaauuauucagcuacaauaugugaugaaauucugacacaugcuacaacguggaugaaccuuaaaaacauuaugcuaggccaggcacaguggcucacgccuguaaccccaacacccugagaggccaaggcgagcagaucacaaggucaggaguucgagaccagccuggucaacauagugaaaccccgucucuacuaaaaaugcaaaaauuagccaggcaugguggugcgggcaugguggcacgugccuguagucccagcuacuugggaggcugaggcaggagaagugcuugaacccaggagguggagguuguggugagccaagacugugccacugcacuccagccugggcagcagagcgagacucugucucacaaaaacaaacaaacaaaaaaaccacauuaugcuaagugaauacgccacacauaaagaggauaaacacuguaugauuccacuuacaugagguaccuagaaugggcaaauucacagaaauuagagguuaccgggguguggaaaaugagaauggggaguucuuuguggguuaagaguuucugccugggaugaugaaaaaguucuggaaauagacaguggugaugguuacacaauacuguguauaaagguacuuaaugccccacugaauuguacacuuuaaaugguuauguuauauguauuuuacaacaacaaaaauaaauuauacuauguguaaacuauaccacaauaaaguggauuuuuaaaaaacaaaauacaaccaggcacgguggcucaugccuguaaucccagcacuuugggaggcuggggugggcggaucucuugaggccaggaguucgugaccagccuggccaacauggugaaacucugucucuacuaaaaauacaaaaauuagccgggcgugguggcucaugcuuguaaucccagcuacucagggcaggagaaucgcuugaacccaggcggagguugcaccgagcugagaucacuccauugcacuccagccugggcaacagaaugagacuccaucucaaacaacaacaacaacaacaacauaaauaaauaaauaaauaaucauucagacuuuaaaccauuaaagaguuuaagaacauaaaaaacagaaugacuauucccaugaauugcauauuaaacauauuuacauauaagaaaaacagaaaacgugaaaauuuauagaauuauuuucuuuaacaacaguaaauggacacaaaccucccauugagugauuacauuuuucagcuucuggauuucagcaucuuuccuuucaagcucuaacuuuagucuuucaauucuuccaucuuucagaaccacuuccugaaaagagagaaacaacacuuuaggacuuugauuauuccgcuaauucugguuuauaguauuccuuugugaaaaguuuaagaggaaaaauucugaccuuaauuuucugaggccaccuuaugcuguugacuacauuucuacuuucacucaauuauauaauccuaauacacaaugcaagcaaggaaguauuuauaauuaagccaaacauacugacaaacaauaucagggcuuucaaaggauauuucuauccuggaacaaacauauuaaaagugcucugugacaaguuguuguuauuagucuaucuuaaaaauucaaaaauucaaaaaaugacuacaaauacaaaauuaauaaaaaauaugaaaacuaaaauaaauagcuuuucacuguauuagcaauuaacagguagaagacagaacuagaaaaauaauuuccucacaacagcaagaaaagcuaaccagaacaauaaaacuaggaagugaucaggaccaacacuaagaaauuuauaaaaucucgaaaaugacacagaacaaaguauguuuguaaauaggaaggcuacagguuacuuuguaaguucaauaacauuucaauagaaaucccaauaggauguuguucuuuggaacuuaaaaagauaguaaagacuucaucuggagaauucaggauagacgcaaacaaaaaguugauuugaugaagaaagauuugucuaucaauuauauaaggcaaaauaaauaaaaucauggaaccuagguugacagaacaauguaccagaaaagaaauccagaaagagacuucagauauaagaauuuauuguaauguaaggaugauacuuuuaaaaagugagaaaaugcugaauuacagaauaaugguagguuacaggacaaguggcuaacugggaaaaaucagguuaaaucccugucaucuugcaccauauaccaaaauaaacaaauuuaguguaaacaaaaaaucaccccaaagucauaccuuugaugagaauauaaaugguucuauuuaucuaaggaguaauguggcaacaucaauguaguacucuacaaauacucacugagcaucuaacuucuaggagcugaguacaccauggugaacagaauugaaaagauucuguguuucuuuucuagauuaguaaagcucucuaaaguggugacacuuaaauugaaccuugugugauggguaggaacuggcuaaguaaaaaggggaagugagagcuuuccagguagaaagaacaguauguuugaaggccaugcaggaagggccuggagaauuugaagaaaaaaauaaaccaguaugguaagauagugagggggaagaugguacaagaugacuuuggaaaagccaguagagaacugauccuggagggccuugaaggccauaagaacagucugcacauuauucugaguaaaacagaaagcagugaaggauuuugaacaggacugcuagguuagauuugacugugugagacuuauguuugcaaaggaucccuuuccaugcuguguggaaaugaaauggagugagguaagacagguagaaagauccuuuaauuacuacucuaacccugggucaaauaagauuaugcuuuggauuagggugaaagcaguauaaauagagagaaguauauuugagaaauaauuuggagguagcauuugaugaaagguuuaaagaauguggcaggugaggaagaugaacacuacaaucuaaguuucuaguuuaagcaaugaggugaguaggucaaaauuagaaauauacuacuauuaaguucuggaaucucacuucuaggaauuuaucuccaauagauaaaugagguagggaaguaucuaugaaaaguguucauuguagauuuaucacaacaaaaaacuggacaucaguuuaaaugccaaacaauaggauauagguuaaauauauaguaaauucaaaaacugaaaacuaagucacuaaaaauggugauauagagcuauaaaauaauauuugcaugauuccaaaguuguaaugugugcaaagaaaaaauucuggaagaacauacaccaaaacuuuaacugucgugaacauggguuuaucaaagauuuugcuuuauuguuuacaauuuccuuuuaucaaaauuauuuuauacugaguaaauaaucauggaauaauacuguuuuacuuuugaauaaaaauaaaaccauauauguauuuuuagaaaucuugaugaauaugauuauuaucuuugaauaagaagcccuucugaaauugacaucaaaaaaaagaggaaaaauggaaaagauugguagaugugauuugaugaaagaucucaaaaaaaaaccacuguaacaaaauaaaaagguaaaggaaaaacaaaauaaauugcaaccaauaugacagacauaugaccaacaaacauuaaaaaaaguacaaucucacuaguaagcaaauccagguuuuaucaaacugguacuuuuuuuuuuuuuuuuuuuuuugagacgaagucucgaucuuaucucccaggcuagaguacgguggugugaucucagcucacugcaaccucugucucccagguucaagugauucuccugccucagucucccaaguagcugggauuacaggcgccugccaccacugcuggcuaauuuuuguauuuuuacuagagacaggguuucaccauguuggccaggcuggucuugaacuccagaucucaggcgauccaccugccuuggccucccaaagugcugggauuacaagcgugacccaccgcacccagccaaacugguacauuaaaaaaauuuuuuuuucuuagugugauuagaggcaauuuaccuauaaacugaauuauuucauguauaagaauuaaugucccaggcacaguggcucaugccuauaaucucagcacuuugggaggccgaggugagcagaucaccagaggucgggaguuugagaccagccuggccaacauggugauucucuacuaaaaauacaaaaauuagcugggugugguggcacaugccuucaaucccagauacuggagaagcugaggcacaaggauggcuugaaccuggaggacgaagguugcagugagcugagauugcgcuacugcacuccacccugggcaacacagugagacuccaucucaaaaaaaaaaaaaaaaaaaaaagaaaacaaaacaaaaagaauuaauguccugaaugcucaucauuuguauuuaacugaaaaagugguccaucuaacaguuucuacauuaaugagggaaaaagaauauauccauaguaagaccacaccaaauuaucaguacuguaguaguuuucucuaggugaaugagauuagggucauuuuucucccacuacaucugaaaacuggggaugauaaugauacccaccaacuucauaguuaguuguuaauaaucaaaugagaucaugcauuuuaaguacuuaacacagugccuggcauauacauagcaaaccucaaauacuuauuuuugccauuaucauuucuucauuuuacuuaucagcaguucccaaaauuucuacaagagauacuacuuuuuaaaacaaagucauauuguuuuaauguauacucauuuucaaugaaguccuauauuucaauaaauaccuuuuaaaaaguaucuucuaaguagaaaauauuauacuaaaaugaggaugaaaagauguacaagauaaagccuaugcugacaagggcucuguaaucuauuaaaaaugacagggaaaaugugcagugugaaaugugcaguaagaaaaacaaaaugcuaugggguauagaaaaaggaaaauuauauccagguuuuccgugucucggguuugggguuuggcuggggcagugagagagagcuucugggaggagauggcaugugaaaugaaugaaaugaaccuugaauaaagcugggacccacucagcauucugugacaggaguggucugcuccagcuagaagaaaaauuggaagaguacaaacagcuaaaguuaauuaaguuaaggauauccuguauaacaauguuuucaaacuuauuugacagugacguaugauagguuuuauacaaacacaugcacacauagaaacaaauuucacaaaauauaaauaggugucacauacucugacauuuucuccugucccauuuuuuugguagcaaucuacuaaacugauuuuagggccuauugaauggguugggaaacucaguuugaaaagcauagccuaaggacuuugggugucaggucaaggacacuguacuuaauucaacagacacugaaguuuaagggcacagcauggcaugauggcaguaaugauuuauaaaaaggcauuaguuagcaggguguaacacauuauauggcauuaaaggcaagaagcagaaagauugguuagauuacugaaauaaugccaguaagagauaaugagagccuaaauuagagaaauguugguaagaauggaaacaaagauagaucugaaaaauauuucaaagauuuaaaacucuaaaaaucuugaaaaacagaaaagugaaaaaaaaaaaguguagaaucuggauaucuagauaaaaugaggaaaccaaaaacugaaaugacagaagucaagccaaaugcuugguauggagaggaagaugaugagccuggguuugaacacagugagacuaagguauccaucaaacaacaggauggaauaugccgcaaggguaauuaauaaaacagagccccgaaggccacaagaggggacaggaucagggauaacugaccuaccuagcguuggugcaguuguggagaaauuaguaaucucacauccugcugcuagaagacaauaugcugaaugcaccaagagcaacacagaggcuuauauccuuugauucaauuauuaucuuaaaaaaucgauuccaaggaaaugauucaccaaaaaauuaaauguaugaucagugaauaucaagccaucaauucuaaacaauguucaauaauagggcaaauaccaagcaacuuacagcauguugauuuggcaggauauaacaccuggauuacaaaagggguuagaaaacuagauucauuauuguuguaauuauuuuaaaauaccuaugcaucuaggcauuuuccuagaaaaacacuauucaaaaaugaaacuaggcuggauacgguggcucaugccuaugaucucagcaauuugggaggcugaggcaggcagaucacuugaggucaggaguucgagaccagccuggccaacauggcaaaauccugucucuacuaaauaaauaaaaaaauaauacauaauaaauuagcugggcgugguggugcaugccaguaaucccagcuacuugggaggcugaggcaggagcauugcuugaacccaggaggugaagguuguagugagccaagauagcacuacagaacuccagccaggugacagagacuccaucuccaaaaaaaaaaaaaacugaaugacagacagacuuaggguugauuuacuuuucaccuuuaaaaaugccuaauauauuaauguaugcacaguuaaaaaggauuuuaaccuuggaaagcagaagagcuuucuuucucugagaaaggagcacauuggauagaggaaagaaguauauacagaaagagaaguggagaauuuuuuaaacugcaugaauccucuuuucucuccuuuacacuuaaugaaagcuaagaaaaacuucuaauuuuuucauuuaugaaaaacuucacaugcgcaaaagaauuuuauguacgacacauuagguaaaaagaaaaauaaaccaaaaagcagauuaagaauuugaacauuaccaauaccuuggcagccccuccccaaucauaccccuuuucccuccucuucugaggauauccaugauuacagauuuugucguucuuuuccuuuguuaaaguauuuuacuacauguauaugaagcccuaaauaauguauuaaauuucuauuuuuaauuuuuauuuauuuuuuugagacagggucuugcuucaaugcccaggcuggaagggaguggcaugaucacagcucuaugcagccuugacuucucagguucaaucaauccucccaccucagccuucugaguagcugagacuacagaugcaugccaacucaccuggauaauuuuuuuuuugcagagacaggguuauuaaaaaaaauuuauaugaaugucaucaaauuauuauuuggugacuuauguuuuucauuaaaugcuaugcucuugauaugcauccauguugcuauguauaacuacaacuuauucacuucucuuauucuuuugcuauuacaaacaacugaguuuugaacauuuuuuuuggacaugucuucaggguuuaaucuagggguagaauuucuagaacauaaggucaugcccauuaucuucaacuuuaaaagugaaugccaaauuguuuuucaaaaugguuauaccaauuuacauucccacuagugguauguuaaugcuguucuauauccuuccuaauaauuaguagucuuuaccuuccuucgguuuuuuccuaggcacugcagugaaauuaauauuacuguaauaaacuuugcuuucugcucaaaaaucuucaaaaagucuuuaacgucugcugacuaaauuauaaaccagccuuuaaauuugccacagucuuuuccaacuuaacuuuucaaauuuauauuacauuccucuauaaaccuucuauuuuaauuaaacugguuuauacuucauuaccuccauacuuuuacucaaggcaucccaguuucuucuucuucaucucugcauguucaaauucuauugucuuuauagaacagcugaauggauuaaaaaauaagacccaaugaucuguugccuacaagaaacacauuucacccaugaagacguaaaagagauauuccaugccaagggaaaccaaaaaagagcaggaguagcuauauuaauaucagacaaaauagauuucaagacaagaacuauaagaaacaaagaaggucacuauaaaaugauaaaggagucaguucagcaagaagauauaacaauuuuaaauacauaugcacccaacacuggagcacccagauauauaaagcaaauauuauuagagcuaaagagagagaugggccccaauacaauaauagcuggugacuucaacacuccacuuucagcauuggacagaucuucuaguaagaaaaucaacaaagaaacacuggacuuaaucugcacuauaaaccaaauggaccuaauagauauugacagaacuuuucaucugacagcugcagaauacacauucuuuucuucagcacacagaucacucucaaggauagacccuguguuaggucacaaaacaaguccuaaaacauuaacaaaauugaaguaauaucaagcaucuuuucugaccacaaugaaauaaagcuacaaaucaaggacaaaaggaauuuuagaaacuauacaaauacauggaaauuaaacaauauccuccugaaugaucagugggucaaugaagaaauuaagaaggaaacugaaaaauuucuugaaacaaaugauaauggaaauaacacaccaaaagcuauggaauacaauaaaugcaguacuaagagggaaaguuauagcuauaagugccuacauccaaaaagaagaaaaauuucaaauaaacaaccuaacaauuaauguuaaagaacuagaaaagcaagagcaaaccaaacacaaaaugagaagaaagaaauaauaaacaucacagcagaaauaaaugaaacuaaaaugaagaaagcaauacaaaagaaauaaaugaaauugaaaugaagaauccaaaaguugauuuuuugaaaaauuaaacuugaaaaaaaaccuaaaaauuaaaaaauuaaaacaaaaaacaucaaaaaaagaaaaauuaaaauugacaaaccuuuaaccacaucaagaaaaagagaagauccaaauaaaacacagauaaaaaaagagacauuaugacuaauacuacugaaauucaaaggaucauuaguggcuacuaugagcaacuauaugccaauaaauuggaaaaucuagagaaaauggacaaauuccuagacacauacaaccuaccaagauugaaccaugaagaaauccaaaaucgaacagaccaauaauaagauugaagccauaauaaaaagucuuccaguaaagaaaagcccaggauccaauggcuucacugcugaauucuaccaaacacuuaaggaauuaauaccaauccuacucaaacuauucugacaaaagaggaggagggaauauuuccaaacuccuucuaugaggccaguauuacccugauaccaaaaccggacaaagaaacaucgaaaaaagaaaacuaggggccaauaucucugaugaauauugaugcaaaaaauccacaaaaaauacugaauucaacaacacauuaaaaagaucauucauuaugaccaagugggauuuaucccaggaaugcaaggcugguucaacauaugcaaaucaaucaaugugauacaucauaucaacagaaugaaggacaaaaaccacaugaucauuucaauugaugcugaaaaagcauuugauaaaauucaacaucgcuucaugauaaaaaccuucaaaaaacuggguauagaaggaauauaccucaacauaauaaaagccauacacaagaaacccacagcaaguaauauacuggauggggaaaaacugaaagccuuuccucuaagaucuggaacaagacaaggaugcccacuuucacccuguuauucaacguaguacuggaaguccuagcuagaguaaucagacaagagaaagaaauaaagggcaucuaaauuggaaaggaagaagucaaauuauccuugucugcagaugguaucacuuuauauuuggaaaaaccuaaaggcuccacaaaaaaacuauuagaaccugauaaauucaguaaaguugcaggauacaaaaucaaccuugaaaaaucaguagcauuucuauaggccaacagagaacaaccugaaaaaaaaaucaacaaaaguaaucccauuuacucccauuuacaauagccauaaauaaaaauaaauaccuaggaauuaaccaaacaagaucuccauaaugaaaacuauaaaacacugaugaacaaaacugaagaagagaugacaaaauggaaagauauuccauguucauggguuagaagaaugaauauuguuaaaaugucgauaccacccaaagcaaucuacagauucaaugcaaucccuauuaaaauaccaaugacauucuucacagaaauagaaaaacaauccuaaaauauauaugaaaccacaaaagacacacuagccaaagauaucuuaagcaaaacgaagaaaacugaaggaaucauguuaccugacuucaaauuauacuacagagcuauaguaaccaaauaacaagguacuggcauaaacacacacacacagaccaauggaacagaacccagaacccagaaacaaauccacacaccugaggugaacucacuuuuggcaaaggugucaagaacauacacuggggaaaagacagucucuucgauaaauggcacugggaaaacugaauauccaucugcagaagaaugaaacuagacaccuaucucuugccauauacaaaaaucaaauaaaacuggagcuaccacaugauccaacaauccugcuggguauauacccgaaagaaaggaaaucaguauacugaagagcuaucugcacucccauguuuaucacagcacuguuucuaacagccaagauuuggaagcaaccuaaguguacaucaacagaugaauaaauaaagaaaaugugguauuuauacacgauggaguacucuucauccauaaaaaaagaucuuguuauuugcaacaacauggguggaacuggaggucauaugcuaagugaaauaagccaggcacagaaaggcaaacaucacauguucucacuuauuugugagaucuaaaauucaaaacaacugaacuaauggaguuacaaaguagaaggaugguuacuagaggcugggaaacgcagugagggagugggcaggugguuaggauaguuaauugguacaaaaaaguuagaaagaaugaauaagaccuaguauuugauagcacaacagggugacuauuagucaauaauuuaauuguacauuuaaaaauaacuaaaauaguaucauuggauuguuuguaacacaaaggauaaaugcuuacaagaugugauuauguaagcauugcaugccuguaucaaaacaucucuuggaacccauaaauauauacaccuacuauguagccacaaaaauuaaaauuucuuuaaaaagagcaaagaaaacccaaauucuacucuaaguuucuaauucaaaugcuauuuucuccucacaaagccaucucugauccccuuuccugugaauuacuauagcauuuuaacaguguaucuuuucuggggcucaccauuuuuugcuuguacaaaaauaauuaucuauugagugcauacuguggaaaacauguucugcuaaacauuuuaaauaauaaucuauaacuuuccuaauaguguaagaaaggcagguaauuucaucccaauguaauaaucgauaaaacuguuugauuucaaagucuguucucuuuccacuaugucaaacuaucacuucgguuuaaaucauacugcuacuuaauuauuuaaacuuguuaauauaaaguuauauacccaacuuuguucuauaaaggccuugaggaaccuaaguauguccugaaauauacaaauaucauuccuucuauccaaaaaugaucucagguggcuuuaaaaaagauacuacaaaggggaaaaucauaaugaaaaaggaaaaucauaaucaaugaaaaaggaagaagugaauaugcuaaccauaaauguuaauuaacaugguugcuuggugauacgguuuggcucuguccccacccaaaucucaucuugaauuguaauaauccccaagugucaaggugaaacuagguggagagggcaguuucccccauacugcucuccgguuagugagugaguucucacaagaucugaugguuuccuaaggggcuuccacucuuugcucagcacucguucugucuucugccacccugugaaaaggugccuuccaccaugauuguaagccuccugaggccucgcuagccaugcacaacugugagucaaaccucuuuucuuuauaaauuacccaaucucggguauuucuucauagcagugugugaauggacuaauacaguaaauugguaccacagagagucaggggcugcuauaaagauaccugaaaauguggauaugacuuuggaacuggguaacaagcagaggcuggaacacuuuggaggauucagaagacaggaaaaugugggaaaaucuggaacuuccuagagacuuguugaaugacaaugaaguccaggcugagguggucucagauggagaugaagaacuuguugggaacuggaaaggucauucuugcuaugcuuuagcaaagaaacugguagcuuuuugccccugcccuagagaucuguggaauuuugagcuucagagaggugacuuagcguaucuggugaaagaaauuucuaagcagcaaggcauucaagaggugacagagcauaaaaguucagaaaauuugcagccugacaaugcaguagaaaagaaaaacccauuuucuggguagaaauucaagucuaccacacaagugagaagcagccaaaugcuaaucaccaagacaauggggaaaaugucuccaaggcaugucagagaccuucacagaagccccucccaucauaggucuggaagccuaggagggaaaauugguuuucugggcuggguccagggccccucugcugugugcagccuagggacuuggugcccugugucccagcugcuccagccauggcuaaaaauggggccaagguacagcucagacuuuugcuucagagggugcaagccccaagccuuggcagcuucuacaugauguugguccugugggugcacagaagagaaggacugagauuugggaaccucugccuagauuucagaggacguauggaaacuccuggauguccagguagagaggugugcuacaggggcagagcccucauggagaaccucugcuagggcaguguggaagggaaauguggggucaagagcccccacacagagucccuacuggggcacugccuagcagagcuaugagaaggaaccacuguccuccagcccccagaaugguagauccacccacgguuugcaccggaaaagcugcagacacucaaugccagccgugaaagcagccaguaaguggaggcuguacccugcaaagccacagaggcagaguugcccaacaccaugggagcacaucucuuuaaucagcaagaccugcaugcgagauguggagucaaaggagaucauuucggaacuuuaagguuuaaugacugcccuuuuggauuucagacuugcauggggccuguagccccucuguuuuggccaauuucucccauuugaaaugggcguauuuacccaaugccuguacucccauuguaucuaggaaguaacuaacuugcuuuugacuuuauaggcucagaggcagaagggacuugccuuaucucagaugaaacuuuagacuuggacuucuggguuaaucguggaaugaguuaagacuuuggaagacuguugggaaggcaugauuguguuuugaaaugugaggacaugagacuugggaggggccggggcagaaugauauaguugggcuguguccccaccugaaugucaucuugaauuauaauaauucccaugaguccagggugggaucaggugggagauaauugaauuauggggguggcuucccccauacuggucuugugauagugagugaauacucaugagaucuaauggucuauaaggggcuucccccuucaccuggcacucauucucucuccugccacccugugaagaggugcuuucuaccaugauuguuaaguuuccugaggccuccccagccaaguggaacugugagucaauuacaccucuuuccuugauaaauuacccagucuuggguauuucuucauagcagcaugagaauggacuaauacgcuuggauuguacauaaaauuuggaaguugaggaaagacaggaaaacaauuaaauuuaauucaaugccagaaagaaccucacgaguacgucaggguaggcaaggauuccccacuacugagucgaaaauagauuuuccauaagaaacaguguuauuuauagacaaaccuuauugcugcauuagaguaaaaaguucuuaaagcuucuccuguauaccauauaacacaaauguuaauagaugguguuaauuuacuguaagacugaauuuaccagucuuuguaguaaacaaagcgauaacauccauugaagagaagaaaagauggaaacagaugggaaccagauuauucgaauuuggaauggcuauuguaggaaucugucaaauuuagaaagagaucaaucaaaggacuguuaaguagaaaugagacuauggcaaaaguuacauaguacugauuuucagaugagaacauuagcaguguuuuuagaaauaccuuuuaaacaccugguggcuggagaauuaaaacaggcaaggcagacaauauugugcgagccagugcuacauacuggcaagaaaggaaucacagaaaauuaaggaaguaaggguaaaguguucauggggacauuagugaaauuacuacaaguuucaagcuaggagaauugauggauuggaggucaauauagggucaagaacagguuuauaguuaagacgaaguaagagacuagugguuuuggugauaaaaauaaaugcagacauagaggucugagagguaacacacuuucucuguaugauggaauuuaagauguggcagugaggaucuuggaguaggucucaccucuuccuggucccauauauccaggacugggguaugaggagagaaagcaucuuuuucucccucagauaauauaucuuggguaacacugguuuguagcagaggcuggcaaacuuuugcugcaaaggguccaacaacaaacaucuuagacuuuauggguuuuauacagucucugucacauauuuuuuuuuuuuuugagacggagucuugcucugucauccaggcuagagugcaguggugugaucuuggcucacugcaaucucugacuccuggguucaagugauucuccuccucagccuuccgaguagcugggacuacaggcgcccuccacaacgcucaguuauuuuuguuuuuauuuuuaguggagacaggguuucaccauguuggccaggcuggucucgaacuccugaccucaagugauucgccagccucagucucccaaaagugcugggauuacaggcauaagccacagcacccagccauauucucucuuuucuaauuuuuaaaauuauuuauuuaauuuugaaacacagucuugcucugucacccagacuggagugcaguggcaccaucuuggcucacugcaaccccaccuccuggguucaagcaauucucgugucucagccuaccacguagcugagauuauaggcaugugccaccaugcuuggcuaauuuuuguauuuuuaguagagaugagguuuugccauguuggccagguuggucuugaacuccuggccucaagugaucugcccgcuucagccucccaaguuccugggauuacagacgugagcuaccgugccaggcucuuuucucuuuuuaaguaguauuuugaaaauaugaaugccauucuuagcuuacaguccuuauaauaacagaccacugaccagauuugauucaugggcuauagcuugcccuguuguaaaggauaaaauucuaacuucuuaguuucacagaaaagacauuuaugacauaaaucuaaucuaugucuccagucaugucaucccacacuugcuuaacuguaaacuucuuaguugcagaauuuuucaguuuccuaaacauuuggucuagggccuuuuauauuucaggacgucuguucucucaguucccuuagacccaaagucuuucucuauuucucagcuuauacaguuccucacuauucauacuccaucccaaaugucacuuuuuauauacccaccacaauucacccaagcagugaucaauuaccuuugcuauucaaaaccucuuuuuuauuguucauaucccccuuaaaguuuucauuugugcugaaugaugauccuuuuacaggucuaccucuccauauccccacaacucugagugucuaagggaagaaaggucuuauccaucuucguguuuccacucccucauacgagugccuaacaguacauagcuuauggcacaugcucagcaaauagucaucaaugaaugaacuagucauacaguaugaguauacuucauacuuuuuaauauaaauaccuuugcgugauaauuacuaagaucauauccuaaacuacuacuuuauacaaucauaauuugauucuacugcuuacuuguuuaaaaaauaaaaauuacauuucaauuucacugugauuuuaagagaauuuucuacuuuacaugccugguuguguucaugagcuguacaauuaucuguuccauuauauucuguaagcuguucucuucguuuuucucuaauaagaauuuuaugaacaucaucuuccagucuauugaagaauccuccaucaugugauaaagucugagaagaacucaauuccugucaaaaaugaauuacgauuuacuaucauucaacaugcacugauaugcauuuaauacaccuagucaaccacaagaagggauaugcauuuaguacaccuagucaaccacuagaaggauaaaaaaagaaagaaaaaugacagcuaagagacaaucaacgacuugauccuucuccaucuccagaagauaaaacaguagagacacauuuggaaauuuccuuucauacuucauauuuuuuggacuuagauauugcuuuuuaaauuucuguuauuuauauacugaacaacucuccaauuuaauguguacaagacacugguuuuuuaauauauucacagaguuguacaaccaucaccccaaucaacuauauaacaauuccaucaccccaaaaagaaacuguacccauuagccgucacuccccauuuccuccuaauaccugccacccgccccaggcaacacuaaucuauuuacugucucuauagauuugccuauuauggacauuuuguauauacagaauaauccaauaugugaacuuuugacuggcuucucugacuuagcaaaauauuuucaagauucauccauauauggcuuguaucagcacuucauuccuuuuuauugccaaauaucccauucuacauuuuauuucuccauuuguugguugauagacauuuggguuguugcuacuuuuuggcuauuacgaauugugcugcuauaauauucaugcacaagauuuuguguggacguauuuucaauucucuuggguauauaccuaagaguagaacugcuggugacucuauguuuaaccuuuugagguaucgcuagauaauuuuccaaagcagcccaucauuuuacaaucccaucagcagucaaguggguugcaauuucuccacauucucaucaacacuuguuguuaucugccuuuuucaugauagccaccgggugugaagugcuaucucauugcgguuuucagucgcauuucccugacagcgaauggugcugaacaucccuuuugugugcuuauugaagauuuguauaucuuuuuggagaaaugucuucucagauccuuugcccauuuuuuaacuggguuacuuguuuuuuugaguuguaacaguucuuuauauauucuaaaugucuauaucuuauugaauaugauuuacaaacauuuacuaccauuucauggcuugucuuggcauauucuugaugguauucuuuguaucacagaaguuuuuaaauuugaugaaguccaauuuuauccaagaaaccauugcuuaacucaaaaauuuacuccuauauuuucuucuaaaaguuuuacagauuuagcucauguguuuaguucugugauccauuuugaguuaauuuuuguacacggugugaagaaagggucgaaauucacucuucugcaugacaauauccagcaucauguguugagaagauuauucuuuugcccuuuuaacugcguugggacucuuguccaaaaucaauaguuuguuucugaacucuuaauccuauucuaucaaucuguaaaugucuauucuuaugccaguaccagauugucuugauuauuauaguuuuauguugcucaaucguuuacacugcuuuuuuuuuuuugagacggaguuucacucuuguugcccaggcggagugcaauggcaagaucucggcucacugcaaccucuuccucccaggccagguucaagcaauucucccaccucagccuccugaguagcugggauuaaaggcaugugccaccacgcccagguaauuuaguauuuuaguagagacaggguuucaccauguuggccaggcucgucucgaacuccugaccucaggugaucuguccgccucagccucccaaagugcugggauuacagguaugagacacugcguccggcguuacauuacguuuuaaaauaauuuuuauauaaauuccacaugccaauagaagauuuuuaaaagauaagauuuuuaucacugucuauccaauuauauauuagaaauuuuacauucuccaagaaaaggagcauuuccucuucaacauccuguuaugaagacagagacugaagaaaacauuccucucacucauugguuucaccuaugucccacauucucuuuuuuuugagacagucucacucucacccaggcuggagugcaguggcccaaucucggcucacuacaacccucaccccuuuagguucaagcgauucuugugccucagccucccaaauagcugggauuacaggcacaugccaccacuccuggcuaauuuuuuuguuguuuguuuguuuguuuguuuguuuagcagagaugggguuucaccauguuggccagugggucucaaacuccugaccucaggugauccacccgccucagccucccaaagugcuaggauuauaggugugagccaccaugccuguccccacauucuugaacuacagcuauucacaauuguaucugugggcaaacgaccccaagguucaauaauuauucauacuuuucacuucacauuaucuuagaaaguaaaguguuugaaaaaaauuuauuuguauaccagugcuuacuauaugaaugacauuaaaaaugguugugcaacacuuuauaucuugcaaagcacuuaaacaaacauuaccuuauuugaauuucauaaacaucaugagaaguugaugagcaaguauuauuucccccccaaguaauuauggccuuaagaaugcaugugcgauugcuaagggauacaggcauaacucuaaaauuacugcuucauaaaauaguuccaguauauucuuguaagauuuuauuuuacagcaauaaauacagaaaugcuaaaaaccacugcugagcuucuguggaaagaauaacauacugcuagcaacuaaucagccucuggauuucauaucacuagagauuauaauuauaauuauaauucuagccaaugucccugcuuguugauaguugcucccauuaccaucacaucaugccuaucacaaagggcauucugucccuuaaguacuuuugagugaggccacaaaguuucuuuuugaucuagagaugggauuuuuuucaaaagauacugauaacaaacuauaggggggagaaaagcaaaaauaaaucaacuacuacaucccacacacaccagaaaaaaagauuaaaauauggcaaauguaagaacauaaaauauuuaacauaauaagucuagccaauucaauuucaguuuaauucaaauucugcacaccuauuugguaccaagcacacaaugaauaagacaguauggugcuuauguaaguauagacauacagaucaauggaacagaauugagaaucuagauaugagccuucauauuuaugaucaaauuuacuuuuuaaaaaggugucaagguauuuuauuaaggauauaagaguguugugcugggagaagugucuaugcauaugccacaauucacaaaaauuaacucaaaauauggaucacagacucuuaaaggaagaacuaaaacuauaaagccucuagaauaaaucaucaugacuuguguuaggcaaagauuuauuuaaugaacaccaaaaguacaauccauaaagucacaaacuagacuugauaacaauuuaaaacuuuugugcuucaaaagacacaauuaaaaaaccaaaaagacauccccaaaauauguacaucuauuuuguaucaauaaaaaauuaaaaagaaaaggcaaggcauagccuggaagaaaguauuugcaaaucauguaucugauagaggacuuguuuucagacauauaaagaaaucauacaaaucaauaagaaaauacacaaaaaugagcaaaaaauuugaauagauauuuccagaagauauaagaauggcugauaagcauaugaaaagaugucugaaaucaccaguuauuaggaacaugcaaauuaaaacuacaaucaaauacauuacauacccacuagaauggcuauaaucaaaacaagagauaauaucaagcguuggcaaggaugcguaggagcuagaacucucauauauugcuggugggagugaaaaaugguagucauuuugaaaaacaauuugacagacucuuuaaaaguuagacauaaauucaccacacaacccagcaauuucacuccuaaguaaccaccuacgagaaauuaaaacauauccacacaaagacauacgucaaaugugcauagcaagccuauaaccuggugaauaaacaacauuuauacaaugaaauacuauucagugauacggcugaauuaacuacugccacaugcuacaacacggauauaccucaaaaacauuaugcuaagugaaagaagccaaacacaaagacuauacauucuaugaguccauuauagguuacaagaaacugcaaaucucuagagacagaaaguagaucagugguugccaggggcugaaggugggaguagggauugacuacaaauggcuaugagggaauuuucugagauuauggaaauguuccaaaacuagacuguguuuauggcugcacaaccaugagugaauuauauacuugcaaugggugaauuuuauaguauuuaaauuauaacucaauacagcuguuuaaaaaaaaaacacacuugaucccacaccauucuacuuaaaaacuagaauauuaccuacagaccuuauggcccaucuauauacucuucccuuagucucaucuucgugccucgacaagguaaccauuaccucaacuuaguguugaucauuuccauguuuuuguuguuuuacagaugcaucacuaaauaauauaauuucauuuuguuugguuucuuaacuuuuuauuaugaaaauuuucauccauauacucuacauuuagauuuaaggauuuucuacauuuagcccuccuuuuugggccuagguauuuuauaauaaaaugcaguuauuaugauaguucaucucgaaauucuuucacaugcagcuauaaaaaauuguccaauuuaaccauauuaucaucaucauaccuaacaaaaaucauauuuguuaacaucaccuuauuccuacuuuauuauuacuauuauuauuuuguagacaguuuugcucuaggcacgugccaucacacccggcuaauuuuucuaucuuuaguagagacgggguuucaccacauuggccaggcuggucucugaccuccuggccucaagugauccacccgccucggccucccaaagugcugggauuacaggcgugagccacugugccuggucuauaccuacuuuacauuaauucaagauggauuuaagacuuaaauguaagaccuaaaacuacaagaauccuagaauaaaaccuaggaaauaccaauggggacacuggccuugggaaagaguuuaugaccaacuccucaaaagcaauugcaggucaggcacgguggcucacgccuguagucccagcacuuugggaggucaagguagguggaucacuugagccccggaguucaagaccagccuggacaacauggcgaaacccugucucuaccaaaaauacaaaaaacuagcugggagugguggcaugugccuguagucccagcugcuguggugggaggauugcuugagccugggaggcagagguugcaguaagcugagaccgugccauugcacuccagccugggugacagagcaagacccugucucaaaaaaaaaaaaagccaauuguagcaaaaacaaaaacugacaaacgggaccuaguuaaacugaaaagcuucggcacagcaaaagaaacuaucaauaaacagaaacccccuuuuuuuuuuuuuuuuuuuuuuuuuugagacagaggcuggcucuguugccagguuggagugcagcagugcgaucucgacucacugcaaccuccaccucccggguucaggcgauucuccugccucagcuccugaguagcugggacuacaggugcaugccaccacacccagauaaguuuuguauuuuuaguagagacgggauuucaucauguuggccaggacggucucgaucucuugaccuugugauccgcccaccucagcuucccaaagugcugggauuacaggggugacccaccgcgcccggccccuucuuuuuuuuuuuuuaagagaugaagucucacucugucgcccaugcuagagugcgguggugcuaucauagcucauccuggaauuccugagcucaaaugaucuuccugccucagcauccagaguagcugggacuacaggugugcaccacugagccugcuaauuuuguuuaugaaaauuuuuagagaugggaucacacuauguugccuaggcuggucuggaucuccuggccucaagcauuccucucaccucagccucugaaguagcuggcauuacaggcgccagccaccaugccuggcucugggcucgucuuguauauucccugucaucgcccuagauacagccauuucuccaacgaguccugguuccuuuuacuggagaaugguuuuagaaacaguaaucaauuuaacaucauaaaaauaaccucauauucuaugaccccgaugugauaugauaggaaauauaucacaccaucuaggaaauauucuugccucccucaacuccucaagaaaacaacuugauggaugacagagccuuggcagauguuaaaaaggaaaaaaaaauuuuuuuugaaagaaaacaacuugagucgggcacaguggcucacuccugaaaucccaacacuaugggaggccaaggccgguagaucacuugaggccaggaguuugagaccagccugagcaacccagugaaaccccgucucuaauaaaaauaaaaaauuaacugggcguggugcugggcgccuguaaucccagcuacucgggaagcugaggcucaagaaucgcuugaacccaggaagcagagguugcagugagccaagaucgugccacuacacuccagccaggaggacacagagagacucugucucaaaaaaaaaaaaaaaaaaaaaaaaagagagagaaaagaaaagaaaaagaaaugaaucuaucaaaccucaaaagcuaauuaacaguuuauaagaaauucuguaaagcuauaaccccgagauucccaaguaaucaugugaucucgccugaagugaaggaacagauagcagcugagaguagggagugaaauggagaguccuaaagcugucuaaaugccuggauccagucaacuaugaggucaacucucccccuauucuuccaugaugugguuacauuaaccaaauaacugucucuguuuuguuuaugcuggauugaguugggcuucuguugcuuauaaccaaagagagcuaacaaauguaacacauacaaacaaggaaaggcuuaguaacaagaaugagcucaacacacugagaagaauagaaaauagguugaaucuuuagguaaaaccagauucuaggugagauuuauuuaaagcuagauuaaauuuauuugcuuuuaaaauuuaauaaccuaaaaaaaagaaaagaaacaaaauaaaaaauuuaggccaggugcaguggcucacaccucuaaucccacuuugggaggccgaggcagguggaucacgaggucaagagauagagaccauccuggccaacauggugaaaccccaccucuauuaaaaauacaaaaauuagcugggcaugguggugcacaucuguagaccccagcuacucgggagacugaggcacgagaaucgcuugaacccuggagguggagguugcaccacugcauuccagcuuggcaagauagcgagacuccaucucagaaagaaaaauaaaauuaauagucuaauuugauuacugcuacacuccuguguguugguagcauuaacaauaggguucauuuuuuuagcguauuuuucuuuauucuuuauuucaauugcacucugaucauuuaucauaauuuuagaaaucaacagauccaacauuacuuuucauaauauaacuagggccuaaagugaauaaauuauuuguccacgcucauaaucagcuaaagguagacauguggagcauuagugcuaaagcacagugcuauaagaaggaaguagguuguagagacagauaggacuggguuuguucccugguuccuuucuucacacaguucuuuuuauuuuuaauauaauuuuuacauaaguaguacacggacaugauagaaaauucagaagcuuauacuguaaaaagcaggcaggcuauuucuccuaucccucuguccaauaucucccccacugccaccuuugacaaccacuguuacaguuucuuggguacuccuccaaugauagugcauucaagcauauugaagacuggaucauuuagacuucaagacauaugaugaucacuaagauuuuuaaaacuaaaaccauacuagaaggacuggaguuuggaaggccagauaaaauugggacuagagagaaaugaguaucuaugagauacccuuccuaacaguucuggcauuuaaaaagcaacauauuaaaaaacaaaacaacuucaguccaacagaagaaaaaagacuaagaaucaaauaaaacuccugaaaaggcaugauuuguugagauuuuauaaagagguauguacaagcaccuacucuagacagaagaaaaaagaaauaaugaaauuaaccugagaacaaguuuagcuagcaccaagaauauauaugcaguucaaguacaccucaucacccaucaauaaaguaaaauauuuucccuucugaauguuauccaauaaauaucugauuuaaggggagguagguaagaagaauauuauuugccacagauguuaggaacuuaagaguagccaugaaaaaaaaaucccuuggccuaaguaauauauuaaagauggaaugaauuaaguuaaucauucagcauacgacguuaacaaaacuaguucauuuguaggagcaaauaacauuuuguuugagaguucaaauuggaauuuucuuuaggcuuuuuuggauucucuguggaaaaaaagaucuucuaaauuucuagaucaaugguauaaccguuguaacauuuaaauauuuaagucccagaaagaaaugccucuaauggaaauggaacauaauuucggcauacuuuuaacaaguaucaaaagguacaccagucagaauggcuauuacuaaaaagucaaaaaauaacagauacuggcagggucacagagagaaagaaaugcuuauccacuguuggugggaauguaaauuaguucaaccacuguggaaagcaguguggcgauuccucaaagaacuaaaaacagaaauaccauuugauccagcaaucccauuacuggauauauacccagaggaauauaaaugguucuauuauaaagacacgugcacacauauguucacugaagcacuguucacaauagcagacauagaaucaaccuaaaugcccaucaaugguagacuggauaaagaaaacgugguauauaugcaccauggaauacuaugcagccauaaaaaagaaugagacuguguccucugcagggacauggauagagcuggaugccauuauccuuaacaaacuaaugcagaaacaaaaaccaaauacugcauguucucacuuuaagugggaacuaaauaaugagaacacauggacacauagaggggaacaagacacacuggggcuuaccagagggugaagggugggaggagggagaggaucaagaaaaauaacuaauggguacuaggcuuaauaccugggugacaaaauaaucuguauaacaaaccaccgugaccaaaauuuaccuauauaauaaaccuacacauguaccccugaacuuuaaaaguuaaaaaacaaaaacaaaaauaaagauaaugugaauuacauauucuuauaaccaaauucuuaauauaguuguaagggaaauaaaucauaauuagacuguauuuacaaauguggaacuuaaucagaaaucuucaaaaugaauuuuauuauauaucagauuauuuaacaagacagaacacagcucuaaaauaaggaaagacaagauauauuauucuacauacagaagcuuguuuaaauacaacucaucuuuaauauauuaaauagguaggaucuugucaguuugcauuuuuugucuucuuucaaaucaggaaagaagaaaacgcaagcaucaaacaguuuauagaguugucuuaggagcagguacaccauguguaucugcuuucuuauuuguauaacacuaucccccaaauaaaucaauggacaaaaauaaauuggaaucaguucaaaaguauguuuuccacuuucaaacauggaauuaauauucagucuauauauguagucauuuaaauuuuaaucuaaaaaaugaugacaaugguuugcaaauaacuuuuaaaaaaauugaccaucuguuucaacaacaaaucaauucuguguuugcaugcauaguuaggaacuaaauuauuaauacaaucacaaaauuauuuagaugugauuuuuuuuaagagauagauuucguuuuccuagccugugaagcaaauguuugaaacaaacaaaaaaauggucagaagccauauauauauauauauauauauacacacacacacacacgcacauauacauauacauacauauauacacauauacacauauauguguauauauauacacguguauauguguauauauauacacguguauauguguauauauauacacacauauauauacacguauauguguauauauauacacauauacacacacacacacacacacacacacacauucuaaagugaaaucgaggaccaucugaccauaaaaaauuaaacaacggaaugccuaauaagaacacauauauaauagaagaauaaaacuuugaaauuaccuuaaaagauaaaaauaauuuuaacauuucauuaguaucuuccucaauguuagagcauuuuuuuaauagcacaaucucccaacuaaaagauuuggagaggcuauacuauaguauuuaaauaacagaaacaaaaaaccccaaauccccaacaccaggaaguguaggcuacacuaacagugaaugguaagagaaguauauaaucagguuacuuuuacccaugaguauaucuaaagaaucacaguuuauuucaaacuuccauaauuccaaaauaauaugagacaucuucucaggauaaguuuuuaauaaagauuaaaauauagagugagagauuaaaccacuuuucucugagauuuuaagcuuggcacacacaaaguaaccuuuggcucauacacauauauauacaaauuaggaugauaaagccaaauuauauuaugcuucaugcaaauaaucuuauuuuuauucuacaacaaugcauuuuacauccuuauauaauggcagaaacaugacuggguucacucaagacaaaccuauggguuguccuuuaaaugauuaugucucaaaaaagacuuacugcuaaguauuuaaguauuauucuuaaaaucaucaguguuuucuacaagauggcuacaauaagacuuaccucagucuuuuuacuaaugugaucuguaaaugaaaaagaaacaaagaugaaacuuuauugaaggaauuuaacauacaaaaauguaaaaaaaaaaaaaaaaacgaaacugaaagaauuucaaaauuaucuccuaugaguuauagaagucauuuaagaguuuucuaggauucucaucugauuuacuuuucuagguuuaagauguuaaaauucaguauauaauuacuaauuuacucagcuuaaggaacgucuuauccuaguaaaucccacccauaucaagggauauuauugcauuuuaagcauaugaguuccacauaaucuaguuuuuugguuccacauaauuugggagguggggggagcaagucaaggggacacaaguauguccaaaaucaaaucacagguuacuauaacuacaaaaaauguucagauuacugcuuuuguguaaugaaaagguagaauaguaauuuauguccuuuaaaacuacuagcuauuuuauuuuaaaagcauauaucaaggugauuuaauagcacuauuaaaaaaccuaaaaauugauauauauuuauagacuuaacauaaaaaauaacccauaacaaauacaucuagaugaaacaaauuauuggcuuagaaacaacacagcauuucuggaaaggaauuaucaagagcagaaugaggaaagcauaagggaaucuaaaguacaaauaaggccaggggcuauggcucacaccuguaaucccagcacuuugggaggcccaggcgggcggaucaccugaggccaggaguuugagaccaggcuggccaacauggugaaaccccaucucuacuaaaaauaaaaaaacuagccaggcauggugguacacacuuguaaucccaauuacuugggagacugaggcaugaaaauugcuugaacccaggaggcggaggcugcagagagccaggaucaugcuacugcacuccaaccugggcgacagagcaaaacucugucucuaaauaaaguacaaauagugggcaaguauucuuauuuaaaguagaugaucagguaucuaauacuuaacaaugcuucuuguguacagcagaaauuuucuauucucaaggacuaaaaauauaacuuucuuaugacugagaaucuaaaagcugguccaguucucuaaagaauuucuugaucagaauaguguccauaaacacaguaaaugccaaaaucaccaacuuuagaucaaacuaccaaaucuugguaaauuagacagucacucuucuagcacgcucuauuuagcauacagugaugccagaaccuaaggaagaaccucaacuguguuaaucaugacuugcaaaagcuguguagguucucuuuaauaacauacugauguuuuucucaaauuuacauaccauuuaagaaaucaaauguggaaaacaggaguuuuagaaagcauucuuuccauguuucugccuaguuuuuaauaaaauguauuucuucuuuuuuuuuuuuuuugagauggagucucacccugucgcccaggcuggagugcagcgguacgaucucggcucacugcaaccucugccucccggguucaagugauucuccugccucagccucccgaguaguugggacuacaggcgcgugccaccaugcccagcuaauuuuuuguauuuuuaguaaagaucgguuucacuguguuagccaggguggucuugaucuccuaaccucgugauccgcccaccucggccucccaaagugcugggauuacaggcgugagccacugugcccagccacuucuuucuuuuuuuuuuaagagacaagaucucacucuguugccuaggcuagagugcacuggcaugaucauagcucacuauagcuagccucuggcuccuagccucaagugaucuccugcuuuggccucccaaagcacugggauuaaagguaugguccacugcauccagcccaaaauagauuucuuaggugaaaucuuuuuuacuaaucuuggauuuuuuuuuuuuuuuugagauagauggaguuucgcucuuguugcccaggcuggagugcaauggcgcaaucuuggcucacugcaaccuccaccuuuuggguucaagcaauucuccugccucagccuccugaguagcugggauuacaggaaugcaccacuacgcccagcuaauuuuuuguauuuaguagagaugggguuucaccauguuggccaggcuggucucaaacuccugaccuuaggugauccaccugccucagccucccaaagugcuggaauugcaggcgugaugagccaacgcgcccagccuuuuuuuuuuuuuuuuuuuuuuaaagaugaagucucacucuguugucccaggcuggaguccaguggcacaaccuuggcucacuacaaccuccaccuccccgguucaauagauucuccugccucagccucuggaguagcugggauuacaggcacacgccaccacacgcccaccuacucuuuguauuuuuaguagagacaggguuucaccauguuggccaggcugggcucgaacuccugaccugaaauggaucuaccugcguuguccccgcaaagugcuaggauuacaggcgugagccaccacgcccgaccaaaacuuggaaauuuuaauauguauuuguucuuuuaaccccaaaacaaagcaacuuaaucacuggcagccuacagggaaaaacuuccuugauccucaaaggaaaacaauauaaucuucuaaauauauucucugauuuucaaagaaaggcuuauuucugaaagcaguauuuggguuuuuuucuuuuugaaauuauugcuaugguaauauuuauccucacagaacaaugcccaauguacuaaggcugaauucauaugagucaaauaaaaugcucugucaaugaacaaauagcuguucauacggugagcaacuauucugacggguauagacacagcgcuguucaauaaaauuuucugugaugauaguaauguuguauagcuggacuaacauggaagcuacuagucauaugugacugagcacuugaaauacggcuaaugcaauuaagaaacuacauuuucauuuuaauuuuuauuaaauugccacacaugaauaguagcuaccauacuguacagcacaggcuaaguauuuuuaacauuucccacauuaaauauaaugugcuuugcaguuuaucuucaaaaguuuaguggauaguaaaauuccuucugucuucuccauuugauaaaaaauacaaaugauacuauaaacacuuuucugguaauaagucucauucuaaaauuuguauuuuaauuuucuaagaugcaguuccagauaacuugaagaggcugaccaacaauggcugaaauaugaaaauacuauuccugaucuacuguaagccaaaucaguuuauguauaaggaaaaaaauauguuucaagaugacucaaacuacaaaugucaguuuuuauuuucaguaaguuuuaggaaagagacaaacucaaaaauacaaaaagauaaauucuuacuaaaguuuuaugggguuuuaaugacugauuuuaaauuacuuuaaaaccccaaaugguuuuaguuuauuuccaaacaguuuugucccuuccaaaacucauguugaaauuuaaucgcuaccaggugugguggcucacgccuguaaucccagcaguuugggaggccaaggcaggcagaucuccugagcucaggaauuugagaccacccugggcaagauggugaaacccugucucuacuaaaaaauacaaaagacuaguugggcaugguggcauaggccuguaguccuagcuacucgggagacugaggcauaagaauugcuugagucguggaggcggagguuacagugagccaugacugcaccacugcacuccagcuugggcuacagagugagacuccaucuaaaaaaagaaaaaaaaaaagaagaauuuaauugccauuguaacaauauuaagagguaggaucuucaacagguaauuaggcuaucagagcuccacccucacaggugggauugguuauaaaagggcaaauuuggcccccuuuugcucucacucuugccaugugaugacucgucaagaaggcccucaccagaugcuggcaucuugauauuggacuucccagcuuccagaacugugagccaauaaacuuccauucauuauaaaugacccauucucagguacucuguuacagcaguacaaaacgaacuaagacaaagguuuacauuuuuuacauucuacaugauacaugaauaacuuuuacuuauuguuuaaaaauuagaaagacauuuacaacugaaguauaaaacagauguagaauaguucuuuuagcauaauagcauuguauauacauuaccuuccgaaugaaaaucuuuuagugauacugugagaggucugucuuuucccugaugauucuuucuuuuaucuuuuuuauucauaacuuuggacugaguugaaguauuuucagcaucuucauacuccuaaaaagaauuaccaacaacaauuaaguucaguuuacaaacuguaaaauaaacucaccaacagguaauauguuucuuaaaguuuauuuuuuaaagauaaaaggcaaauaaaaaaccaaaauuuaggcuagccaaauuguauaaagagauaccucuuuauucauuuacucaaucccuuacaucuuaaacauuaaaaugaaaacaaaaaaagucauaccuuggccuauaacccccuccucauugcuaccuucuaccuuucaagaccaaauuuaagacaauaaucagcaauuuccugccucaucccacugaaaucuggcuucugcuggucucugauacuaaaguuaaggucaaucuccucuuuauugccauauccaaaacacauuauuuuuuucaagcaucucuugguuuucuuaauacauuucugacuacugcuaaguuuccuuugcuggcuucuuuccucaaccuucucaaaagcguagcgguuguucacauuaucccacucuuaaccuauuuuuuuaaugcuuuauacccacugcucuucaaucucaaaguuuaaaguucuaccaauaaacuaauuauuucuguauagacagacaacugaacuggaauguucaauaagcaucuccacacgaaauguauucuaucuuuccaucucacuacccugccuuccccacucgauccuuuaugaaguaccuuguuaugccaccaccaugugcacaucugucuaaguuggaaaccucagaguauccuugccuacucuccuacacaccuuacagccaauuaacuacuaggucuuguuuaacuuaucuccugaagauaucuuaaauucauucucuguucuuuguacauucugucauucccccaucucccuuuugcuuggauacugcaacagucuccaauuuuagcuccucaauccaucuucuacgcugcuacaugaguuucuaaaaugaaaacccaaaaucaaucuaaaaguuaaaaugauuaaacagcuuucugccaauggauguauaaaacccaaucuccuugccuaguacaugaagaaauuuauguccuauccuucuggcuguaucuccagaaguucuagguccuuaaaugacaguuuuucaaauaugcuauauucuuucacauguacacaucuuauauacuugccacuccuuccuucagaaugccuacuuuccucuugucuaccucaugaacuucuaacacauguaauaagacucuuuaaagaauccuuuccuaaaacccauccccaacaaaggcacugaaaagccuucuauuauucugaauuuccacugcacugagaacauacaucucucaauacuauacacuaugucucccuccacuacacucaaggggcacacuuuggcuauucaauaauuauuuggugaauaacugacagaauagaacagaaaaugcuaucccagccaggcgcgguggcucacgccuguaaucccagcacuuugggaggcugaggcgggcggaucaccucaggucgggaguucaagacuagccugaccaacauggagaaaccccgucucuacuaaaaguacaaaauuagccagggugguggcacaugccuguaaucccagcuacucgggaggcugaggcaggagaaucacuugaacccgggaggcggggguuguggugaaccgagauugcgccauuacacuacagccugggcaacaacagcgaaacucugucucaaaaaaaaaaaagaaaaaagaagaaaagaaaagaaaaagaaaaugccaucccaaacuuuaguuaucuguuauaaaaauccuuaggcuaaaacaauuguauuaaaaguuguuuuauugaauauugacuuuuaucucaaugacuacccaucaaugucaucacaucaaacuacccauugcacacaaaagaaguuccucccuucucuuagucauuauugucggcuaaaaucaaugauuuugaguacuacaccuaugacugugcaaagaacacuggcugggaguacgacauuuuaucaacacuauuuacucuauuucuccucuaaggauacagguaauccuucuagcuuuagaaucuagacauauauccauaagucuaacagcaagaagucaccuuuguauaauauucuauuugauaaauuuuaucuccuaauugagcaagacaggauuacuuuuccgguguaaccugacaguccauuuaaaugauuaaaucauaguaaaacuagcuguaucaauuuuuguuaauuuuccugcuuugugucuaaauggguauguaacaauaaugguuacaguucauucuucguuauuugagguaacagaaagggauauggaaaugaaacacauauaauauauacagcccacuuuauuagcaacuuuuuuccuuuucccuugaacuauaaauaacuagcaaaaucaaugcugugaauuuuuuuguuaagaugggaucucccuuucuugcccaggcaggaggagugcagugggaugaucauagcucacugcauccucuaacugcuggguucaagggguucucccaccucagccucccaaguagcugggaauacaggcucacaccaccaugcccagcuaauuaaaaaaaaauuuuuagagacagugucuugcuguguuaacccaagcuagucucaaacuccuggccucaagcaauccuccugucucagccuccugaguagcugcugugaauuuuaauuauucacuucuuuucauuuuggauaaagacacuaaugcacaaggacauggccaaaaagucuucagggugaccagaggccauuuaugaucaaccacugaguaaucacagcuugaacaaauguuauaaaccaaaaaaggaucccaguaaauguuacggaauaaaauguuaaaugauauuaacguaaugaauacucacacaauuuaaauacggaaacuggaaaccaacacuucuuuuuacuuaaauccuccuuuaauaacaagcuauagaaugcauuucaacacacaaccuaauaucaaagcucagugacaaaugcugaguuuucaaggccaaaauuucagaaauggccuucuacuuuauuugauuuguagugcaacucuggcagagggucucucaauaaaugccccuguacuguaauagcccauauuaaaauuuuaaauccacuuauuuucuauguucauuuaaaauuaaaauaaucggcagggcacaguggcucacaccuguaaucccagcacuuugggaggccaagguggguggaucagcagagcucaggaguuugagaccagccuggccaacauggcgaaaucccaucucuacuaaaaaaacaaaauguagcugggugugguggcucacgccuguagucccagcuacucaggaggcugaggcgugagaaucgcuugaaccugggaggcggagguugcagugaggugagaucaugccacugcacuccagccugggcaagagagugagacucggucccaagaaaaaauaauaauaaaaauaaauaaaauuaaauuaaaaucaucuguugugaauuuuauucucucucuucccuucaucuuggguggggaaauuccuuaacauuccaagucaccggacaaagcuuaauuccaacuguuucuguucuaucucaaaacuugagaaggaauccuauuauaaacacuucuugguaauauuuuauuaugguaaugaauuuuuggacaaacuuuuacagaaaaauuuuauguaaaauucaaguagguugauuuuaaccucucaccacuuaaacuucuaaaauaucuaaaucaguaaguauguaaauaccuuuuugugcucuucauauucuaguuuacuuaguaacaaugccuucucaagaucugcuucaaacauuucagaugucagcuacaaaaaaaaaguuucacaauaaacagacaguaucauuacaucacaugagcaaaauaaccauacauauuacuauauacagaggaaaagaaagcaaauauguuaaaaaacaauauggauucuccaaaguuaucuaaccaugccaaacuaggaagccuauauucuauagaagacaucaaaauacaaacuuccaauuuugagauuuccauuucuccucuucauuguuaucuauuauauaugauauaaucuuacuuuuuaccuuaauaaaaaaaucuuaccaaauaauuggcacuauaauagaugucaaaggcaacauucaguuuaggacacuaaaaauuaugagugauuauuacucaaaaauauaagaauacuaaaaaauaacucaauaagcauuauuaaacacaauaugccauuucaugaauauagaaaaaaccacagguacaaaauaaguuugccaaauguccuggcauaugccagguguuacagaauaauuguucauagugcaucuuuuuacucucaaaaugauaaacuauaugguugcuuuaagucaucuaauaaugauucuuugugauauauauuuguuucucuuuuucacuaaucaaucucaccuaacuuuuuaaaauccaguuuucaccacccuccaauccaauuaaucucuacaagacuuacuuuuccuaauugccaaacagaauguugcaguaguuggaugcgacuuugaguuguccacuacugggcauaaggugaguggguuugcagcuguauauaagauagcugcaacaugacauggguaaacauccuggauuuguguacauguaugugucuauguguacaggauaacaaaagcauaaauuuagugggcaucucuuguuuuuaucuguccagaaucccuuccucgauuccuuuaaauaagugcacuucauuccaaagucccaugguuucagcagaacagccagucgcauaauucuguacacuaagcacuaccauaccacacaaacacccaagcuaucaucaccaaugacaaaaggugggggcaagugauccaauuccuuuuuuuuccucccaggaauuaaauuuugagaacaaaggaaaagcagguggguuuaauuaucugaugauaacccucgaaaaaugacaucuacuagcucaugccucugagcacucccaaauuccuugguuuccagcuuuuucaagaccuaauuauuuaguuuuuaauucaaaucugugaaucacucaguauccuucaaaaaagguuuuuggcuaaguuaaucauaauuguuucuauuacuuaaugauuuuuaaaaaucuaaacuaaaauagaaaccaacuccaaaaagaagugaucuguuucaaggagaaaccuuaaaaacuagaaaaaucuuaauagacacuaugaacuaaacauuucuaagcaaagucaucccuuugaaagcaucuaauccuaugcugauacaauaaaaagagaggaaaaaaagauuaagcuuacacagaaaaacaaucgaaugcagaaaaauacaauuagaauuaaaaugguaaggauauauagaacuagaaaaucagauuaagcccaguguaaauuauacauacuuuauggaauaacugaaaagaauugaagaauuacucugaacuaguaauuagcaagaaaaaguaauaaauuaaucuuuuagucuuacuauauacacuuauguacauggguauucaaugguuauaagguaaaaggaaauuuccaucaauuucuccaccuaaccucauggcaaacugauaauaaaauguuucacuaaacuuaaaggacaguaaucauccuaacagaaaaauuaacaaaacuaggccggcacaguggcucacgccuauaaucccagcacuuuaggaggacgaggugggcggaucaccugaggucaggaguuugagaccagccuggccaacauggugaaauacuaaaaauacaaaaaacaaaacaaaacaaaacaaaaaaacaaacaaacaaaaaaacagccuggcaugguggugcaugccuguaauuccagcuacucgggaggcugaggcaggaguaucgcuuaaacccagaggcggagguugcagugagcugagauugcaccacugcacuccagacuagaugacagagugggacuccgucucaaaaaaagaaaaagaaaaaaagaaaaaguaacaaaacuacuuguuuauucugaacaaagcuuuucaauuugccacuaaaauuuuaaucccuauugaugacauuuaauuauagaaagggcauuugagauuauuucuaauaugucacauagucugaugauauuccagaaauaaguuagugggcagaacagguuaggaaguuggaagucuuguuagaugucauuuuuauuuuucauauuaacuuacagaauuuaaauguuaaggcaguucauucuaaucgcaugauaaaaacugaaugaaauagaaauuuuaggccaggcgugguggcucaugccuguaaucccagcacuuugggaggccgagacaggcagaucacaaggucaggagaucaagaccauccuggcuaacacggugaaaccccgucucuacuaaaaauacaaaaaaauuagccggacgugguggcgggugccuguagucccagcuacucgggaggcugaggcacgagaauggugugaacccaggaggcggagcuugcagugagccgacaucacgccacugcacccuagccugggcgacagagcgagacuccgucucaaaaaaaaaaaaaggaaaauagaaauagaaauuuuaaaguaaaaacauauggcccucccagcaacugauucuaauuguagcucagacuuuaaaucuaccuuuuaauuguuaacacaaacuaguauacaagaaaaugcagguagacaaaaaugauuuaaauuuaaauuuuugaaaacuagaacaaaucuuccaaaaauuucauuguaugaccaaucagccauuaaggauucauuuagagucuucuaggggcugugcccucccugccuauggggcuuaauuuaaagcagcagcauaaauuuggcuuuugcccuugaagaauuccuacccaguugaggauguaagauuaacguguaugaacuacaggaaauagaauaagacauuaaaagagcuacaaaaguugagaaaaagaagaucaacaacaaaugugauucaggaauacagaaaaaaaauccuuuuaaguugguauuuaaauauagauacaauuuggauaggcagaaauagaacugcaggaagagccacauuauguuaauguuauaauauuaagaauagauauacuaugggauacuaaggaaagucauucugacaaaaagugaauuuuaaacauuacaagagaaagauguggaaaaaacacaggcuuugggagaucacagaaauugauaauuuaaauuccuauuccacccaugcuagcugugacuuugaacaaguuauauuaacuccugugaaucucagaacauuuaaaaaggacauuggaauaucaacuguacaagguaguuuuaaggacuuaaaguuguaauauguaugaaguaccuagcacaguuccuggcauaagagcaguaccaaaugaauuagaauuacucucccauguuggagaauaguagaaaauaagauugcuuaguuagggcagcauaagguuccagacacuuccuaaaauuuaaggcuauagggcagaaaaaagaggaaugcuaauauuaaauaaaaguaauuuuuaagauauaaacuggaauauuagaagaaugagaaccuagaaucaaugugucugacuaagccauuguaaucucagacagcauaugggcaccuggaccaaaauguagcagcgcagaaaauaaagaagagacugaucaaguuuuggaacacugacaauaugaagugugaaagaaucaaagauaagguuuuugaccuuagauaacagggagaaugguagcacaagacuaacacauaucagaaaagagaaagaaaaugugauucaaaauucucuaaacauaucuuuauucucuaucaaagacugcuauaacuauagcugacaaucuacuuaaucaguaaauguauagguaaaagagagagggagacagagacagagacugggccuauaagacaggcuccaggcaauaaaaugcaaauaaaagcauacuuuuaaaaaaguaccuuguuuaaguuugcgaaugggaaguuccuuauuauuuucuuuuuauuuaugggaguaggaggaaaggaagaaaaagaggaaauagcaggcacuaaaaugccuacagaauucaagaagauacuuacauguguccaagauggaguacuucagauccccuuccucuugacuuccucauugccuccuacuccccaucuaguaguaaaacauuuuuucuucuauuuaagcaaaccuauagcucaaucaguuaaagaguaugaagaaccaaugaaaaaccuaaaggacaguaaauauuuugguacuaacauuuuuuaaaaauuaauuuguaagucuaaguaccauuacaauuuuacucauuuaaauccaaacaaaauaaauuccaaaugaagaguuagucuucaauucucauaggcaacauggaaauauaguuacuauaaaacaaaagagaucaccauucugaagacaucuaacacuugcagccaacugauuggacuuaauagcaguggugcauagugguccccuaacccauuagauuuucaaaguguagacuacauaucuuucaguaauuuggaaggcaagauuauuuucccagaaaucuuacaguagucuuauugaacauaauuauucuaaagguugucagaguucuacaaaaaugacauauauaauucacauucauuaccacauucaguucaucucagcuaauguauuuuuaugucuucugagugcuguuugcauuuacuaagucuguauuuuuguuguaugcuuuaucacaccuccaagcaauaaaaaugguucaugagucacaaaagaauuaaaaguaguaaugaaaauagaaccguaaauaaugcaacuuauaaaaacacaauaaauuuugaaauuaacaggacuccaauacagugaauauagaauauaaacguguauguguuaggaugagagugaugucacaaaaggagcagaaaaggaaaguuauaaacagaaaauuaagauaaugaauauuuaaaauuuucauuugagucauccaucuauuugcuccuagcuaccugucaugaaaucuggucagaagacugggugugguggcucaugccuacaaucccagcacuuugggaagcugagguauguggacugcuugagaccaggaguucaagaccagccugggcaacauggcaaaaccccaucucuacuaaaaauacaaaaaauuagccagccaugguggagugugccuguagucccagcuacuugggaggcugaggcgggagaaucaucugagccugggagucaaggcugcaguuagccaugaucacaccacugcauuccagcuugggcgaugggaguaagaccccaucucaaaaaauauaugaaaauuaaaaaagagagagaaagaaacuuggugagaccaguggccugaagauaucacaguuuuuguuucacuuucaaacaaagccaagggaccuguaggagucuuuccagaacaacuacuaaguaaugcuuuccagcauaaaagugauuaauuuuguugcuaaagagccaaaaauacaauggauuuauuugaauuuacacuccuuauaaggaaaccagguagucaaacuacugccaagggauuuauuauaccagccacacaguuaaugauaaauauuacacucacaaacaaacaaaaccagaacaagcuauuggaaaaaaaccuuuaucaaaugaacugaaggaugucacguaagagagaacuugcuauugugcacauacuaacagacaugucacuucagagugagaaaaauaccagugacguguagaguuugaaucaauacaguaacagaagaaauacacaauaaaauuuggucuguuaaucacugaaacccuuaagaagagauuuuucuacuuauuuuuugagucaugacuuuuaaaaaaagguacacuggaaucaauaguaucagugcaucaugcauaaagcagauuauaccugaaaaacaucuacacagagauuuauuccuaggcaacagcuguuggugaacaauauguuucuugaucuugauuuaaucguuuuaaaaaacaguggcugggugugguggcucgcgccuguaaucccagcacuuugguagguggagguggggaggggaggaucaucugaggucaggaguucgagaccagccuggccuguaaaaucccaccuccacuaaaaaacaauacaaaaaacuagccgggcgugguggcacaugccuguaaucccagcuacucaggaggcugagguaggagaaucgcuugaauccgggaggcggaggucacagugagccgagauugugccacugcacuccagucugggcgacaagagcgagacuccaucucaaaaaaaaaaaaaaaaaaaaaaagugaaaauuaugcauacaaccaagucaaagccaugcccuacguauuuuuuuaaaaacagcuuuacugggauauaauuuacauaucauuuuauacaucauguaucacaugacacucauuucaauuaagaaacauacacaucuuuugauauauacaucuaagcaaauaaaugaguagggaauauaagaccacuuuuccacaaugaagugugcugggauagauacaaguuagcugcuacuuagaguuaauucuuuauugaacuagcuuaaauacucaccacuaguguuuuuuuuauuguuugugcucuuuauuuagauuuucuuuuuaauugacaggagcacaucucagaaaaauuugcagaaaggauaauggugguauacucucucaguuaugguuaugucugagagugucuuuuuuuuuuuuuuuuuuuuugagauagggucucgcucugucacccaggcugaagugcacuggcaugaucacggcucacugcagccugaguagcugggacuacaggcaugcgcuaccacauccagugaauuuuugcauuuuuuuguagagauggggauuugccauauugccuaggcuggucucgcaaacuccugggcucaagugaucugccuaccuuggccuccuaaagugcugggauuacaggaaugaccugcugcacugggccuaaguguguuucuuucacauucacacaaaugacuucuaggcuagaugugaaauucuuggucuuaacauuuugguucuggugauuaaaguagccagccugauucuucauccuguauaggcaaccaguuuucuccuguguauauauuuauacuacuauuuccuuauuccucauucuuaaaauuagaaucuaauucuuaaaacgcuuaaauuugguguucuuuucaagcuuagauuuuaucaaaauaaucuuuuuucuuuuuuuagagcuagggucucacuauguugcccaggccagucucaaacuccuggccucaagcaauauuccugccucaaccucccaaagugcugggauuacaggcaugagccacugcacucggccuaucaacauaaucucuaauaccugugucucuucuauuuguuucagggacauuaauuaugccucuguuggauuuaaauucaguguuccaaucuaucaugucaauuuuaucagcaaaacuuaucucaaauuuuccuucacagaauuggcucagcuuucuuuaguagauacucugguccuucuaauuaaguuuuuaaucugcuaugauuuuacuuccuaaauuuuaaaauucacccaucucacuuuuuuuuguuuuuuugagauggaguuucacucuuguugcccaggcuggagugcaauggcacaaucuuggcucacaaccucugccuccugggcucaagauauucuccugccucagucucccgaguaccugggauuacaggcaugcaccaucacgccuggcuaauuuuguauuuuuaguagagacgggacuucuccacauuggucaggcuggucucgaacucccgaccucagcugauccgcccaccuaggccucccaaagugcugggauuacaggugugagccaccgcacccggccccaucucaguuuuaauucacccgucucccuuuuaauuucucucagucacuuuuucauuuuagugcauuauuuuaucuuacuuucuuauauaacauuacuauccccuugacuuuuacaaaacguucuagccucuugauuuuuauuaaagcaaaacauagaugcuaucuaaaauaaacuuccauuuccugcagcaaaucuuuuucgaggugugcuuucacuccagacacuaaguacaaugugcuuuuccuucauguggcagaaacuuuucuuccauugauacaagaucaacugagauccaguguuugcucauaaacaggcgaacugagugcuuuccuacuguccaucugguuagguguuuaauucuagcucucagauuguaugcuaaggcuuaguugauguaaauuugcauuaucuauauggugauuuaggaguaggaaacuuuguucuuaccauaauuucucuuucguguuugacauaagcagccaaguaacagcuaaguuuuccauguccagcuuucugucuggcucagcccuccauccccgaaauuucucauacugugucaggaagaacacccccuacauuguaugcuuucugccuaguauauagucauugccugaucccuguaaauguagcuacuuuugaaaucuauuauuacucuauuaauaagauagauuccagacaguauauuguccaucaguugcaaggcuugcccuuaucucuuccucaccucucaguguaauuaucccaagaucuacucuacuuccacacauuauuuucuuccaagugagucucccacauaaggcuccaggucuuccuaagugacccaucaguaguauacucagcagaaauucgucaaaguuccugggccuucaacggcauccuuauauaggaucagggccaagucacacuauuuccuuuucaucauuaccugcucauuucagcagcaaucagugggagcagaagaaaaggcaaucagauaucugugaucaaguucccauguugcauggaauuuauuuuggugcaaauuugaguaguuuuccuucauuaguucuccaguaaacuuuaggccacugggagaaauucucuccaaugaagacacugguaaauucuauuacuggcuaaacaaguagaucaucaaaacauuuauauuuguaaacaagaaucggucauaaugaauauuuuauaagaaaaaaaagaaucaaccccuagaaacaguacaagaugauuuauccaguauaccaguaccuggaacugccauuugaacagcacuacugcauggcucuauaguaauaauuaaugcucauaaucaugagccugaggcacugcaaaauccuaaagaaaauguuauaauuagcacaguuuauguuaagagaauaacucaguauagucuauuuuaaaacugguaacccaagaaugauagaaacagccacucuacuagaccuaacaucugcuagaaugauacuuauucugaaugcaucaaaugauaguuugacaggcaaauaaauaauucaucacuuacuauacauauagcaucuccuagaguacauuccaggcuuaguauguuauuuuccuggacuccacacacaaaaaagauauguauucgucuuaaugaguuaucuauuuuauuugguuguuaaugacauuuaauagagacauagaagaacaaaauaucauguaaacagguuaaagaaacaaacaacaguaaaguuucccaaaggauuucuuuuuuaagcaaaacugucacuggguauuauuuguuuuuuguuaugagacagggucucacucugcugcccaggcuggagugcagugacaaaaucauggcucacugcagccucgaccuccugagcucugaucuucccaccucagccaccugaguagcugggaccacaagugugcgccuccaugcccggcuaauuuuucuguuuuuuuuguagacaaaggguuuugcucuguggcccaggguggucucaaacuccuaggcucaagccauccacccgccucagacucccaaauugcugggauuacaggugugagccaccuguaggcuguacacacccagccuagucacuguguauuuuuaacaagagauuucugcccuacaaaugugauuuucuuacuuggaauaauuuaauacuguuccccuaccuucccugucucucccugauuuguaaaaggcagaugauuuuuaaaaccacaaaauaacugcuuccuauugucaaaacuaacauaaacaacaaauguaucacuuuuguuuuucaguagaucaaaaacagaaccucuuauuaaaagcaacaaauaugaauuaauccaauacaaauugcuucucagaacaguggugacgugaauucagaggcacugccaugugaaaaauccauaaauucaaugaaaaacaaagcaauuuuauuuacuuaguuguaccugcucaucucuuugucuccacucuugccaauuuucuucucgugaauccuucuguacuggguuugacaauggaagaucauguugagcguuacaaacagcaugggaggauuucuggggaauuuucuuaaaagcaagauuccugagcuauaaaacaaacaaaaaauauauuaaauucaguuuaccaauccugggauacuaaugauuuuuuuaauuaaaaaaaaaccaaugauauuuuuauacuucuacugaaaccacucguuuugcuaacucacacagcuaaaguuauuauuuguguuuucuauaaucuuuguagaauguuaauuuugccagcauuugagauaauguugguagaucuauauauaaaaugauuaagugaaaaauguauuauacucuauuauaccaccauuuuaaucauucuucuuuacuaaaaagaaguuuauaggaguagaaaacaguaaaacaagugugcuuuuaaaaugcaaaacacaacugggcucaguggcucaccccucuaaucuuagcccauuggaagggugaagcagguggacugcuugagcccaggagauugagaccagccucagaaauguggcaaaacccagucuucacaaaaaauacaacaacaacaaaaaaacuagccggguguggugacacacaccuguggucccagcuacccaggaggcugaggugggaggaucaccugagcccaggggguugaggcugcagugagcagugaucaugccacugcacuccagccugggcaacagagugagacccugucucaaaaauaaaaauaaaauaaaaugcaaaacaauacaguucagaaagcauacacauuuaaaaguuuaaauagugagagaucgccuaagcaacucugacaacuacuuugcuaguccugaaaaauacagggccuaguccacaaaguaacauaaucaacuaaaacaguaugggccaagccacucccaacaauaaaaauaaucugagacaaaguaguugaaacgagagaaaaauacugagaggcuguuaugaacugaauuuguuaaauuaaguuuagccagcagacacugagcauacugccuaugaguuagcccuguucugcaaggagcaguuuaaaaaaaaaaaaaguuuagccuaaagcugccuccuuacguuuuuuuuuuguuuuuuuuuuuuuuggcagagucucgcucugucgccagcuggaaugcaguggcacaaucucgcucacuguaaccuccgccucccagguucaagcaauucuccugccucagccucucaaauagcugggauuacagucacaugccaccacgcccagauacuuuuucuauuuuuaguacagauggguuuucaccauguuggccaggcuggucuugaacuccugaccucaggugaucccacccaccucagccucccaaaaguguugggauuacaggcgugagccaccgcgcccggcccccacugccuccuuacauauuuuaaguucaacuugaaaguuucuccauacauagugaacuguaaccuaacaauguauaaacaaacuauaaccuacuuuuguaccaaucgcccaguuuuagccaaucacagguggucaacugucaaaccauguucaaauaaggcaaagguggagcuguaaccaguccagcuguuucuguaccucacuuccguuuucuguccacaaauacuaucugaccaacugacagcccaguuguagcucugaaucuauucugguucugggggcugcugaauugugaaucggucuuugcacauuugaaguguucaauuuaauuugucuuaaguuuuuaacaaauuguauccucccuaaagauaccuugaagcccuaaccuccaagugucccugaaugugaccuuauuuggaaauugggucuuuacagauguaaucaaguuaagauaaagucaugcugaauuagguugggcccuaauccaauaugacugguauccuuauacaaagaggugaagacacagauacacagagaaugccacauaacaacacaggcagagauuggggugaggacacagcaagccaaaggaaugccauggauugacagcugccacccagaagcuagaagaggcauggaaagauucuacucagagucucagagaaggaauggcccuuuugaucuguggauuugaaccucuacuagacuccagaacugugaaaaaauaaauuuccguuguuuuaagccaccaaguuuguguuuuuuuuuuuuuuaaggcagcccugagaaacuaauaaagaggauuucaacugaggaucaacaauuuuaacuguuaauauuagguuggugcaaaguaauugugguuuuuaccaaauacauuguucugcaaaagggaguaagauagaaacaccacuguaaguagcugguuucugauuuggaaaggacauucagaaggagaugcugcuggaaaugaagcacugguaggucagcuacuguuugcuuuacagaaaguaaaggcuuauagaacugcaaauggcugaaguggaaaggguggauccuucacacucauucuguuuuauauuuucuuauucucuaauauaaacuccauuauugccuuauuuucuguuucccccaaaucaucuuaauuccuaaaagaaaauagugggcaaucaaaaguucugaaagaucugacuucugaaagguuaucauccagugaggaaaguaucuuuccuuuaaaguuacuguguggauagcauuuuaaagaauauucagaaagcaauggagauggaaauguaauagaaaaaauaaacugaaaaggcuuuuuucuaagucuugggacauuacuaugagaauaaaacacuauucuuucauuaaauaauaaaaagaaagguccuuauauacccaacggcuccuucuauuaaacaaaacacauacuagaguuguagcucagaauuucuuuuaaaaacaaugggcauauuaaauguugggcauuuaaguaaagcuaaggaugucuaggaaaaaagggccuuccauacaguuuuuacucuaaagaaaagaaaugggccaggcgcaguggcucacaccugcaaucccaguacuuugggaggccgaggcaggcggaucacgaggucaggaguuccagaccagccuggccaauauugugaaaccccaucucuacuaaaaauauaaaaauuagccaggugugguggcacgugccuguagucccagcuacucgagaggcugaggcagaagaacugcuugaaccugggaagcagaggagguugcagugagcugagaucacggcacuaaaacccagcucgggcaacagaggaagacuccaucucagaaaaaaaaaaaaaaaaaagaccaucgaaugcauaaaaauguacauucaaugcaaguuacagagggucaggaauaguguugcacaccuguaaucucagcauuuugggaagcugaggcagguggacugcuugaggccaggaguuugagaacagccugggcaauguacugugacccugucucuacaaaaaaacaaaauuagcugggugugguggugcuugccuguaguccuagcuacuugggaggcugaggcaacaggacugcuugaacccaggaguuugaggcuacagugagcuauaucaugccacugaacuccagccuggacaagagagagagauucugucuucucuuuaaaaaaaaaaaauaaaagaggccagcaugguggcucacaccuauaaucccagcacuuugggaggccaaggugggguggaucacuugagcaacaugaugaaacccugucucuaccaaaaauacaaaaaauuagccuggcguaguggugugugccuguggucccaguugcuugggaggcugaggugggaggaucacuugagccugggaggcagagguuguagugagccgagaucauacuacugcauuccaaucuggguaacaagagugagaccccgucucaaaaaaacaaaaacaacuagucauaugauuuuugccuauaacaguaaaaaauaggaaacaacccaaaugcuuaucaugaguucaauuaaauaaaguaugaaauaaccauguagcucccucuccccucuccccucuccccucucccucucggucucccucucccucucuuuccacggucucccucugaugccgagccgaagcuggacuguacugcugccaucucggcucacugcaaccucccugccugauucuccugccucagccugccgagugccugcgauugcaggcgugugccaccacgccugacugguuuucguacuuuuuugguggagacgggguuucgcuguguuggccgggcuggucuccagcuccuagccgcgagugauccaccagccucggccucccgaggugccgggauugcagacggagugugguucacucagugcucaauggugcccaggcuggagugcaguggcgugaucucagcucgcuacaaccuccaucucccagccgccugccuuggccucccaaagugccaagauugcagccucugcccggccgccaccccgucugggaagugaggagcgucucugccuggcagcccaucgucugggacgugaggagccccucugccuggcugcccagucuggaaagugaggagcgucucugcccggccgccaucccaucuaggaagugaggagcgccucuucccggcagccaucccaucugggaagugaggagcguuucugcccggccgcccaucgucugagauguggggagcgccucugccccgccgccccgucugggaugugaggagcgccucugcccggccgcgaccccgucugggaggugaggagcgucucugcccagccgccccgucugagaagugaggagacccuccgcccagcauccgccccgucugagaaguaaggagccccucugcccggcagccaccccgucugggaagugaggagcgucuccgcccggcagccgccccguccgggagggagguaggggggucagccccccgcacggccagccgccccgucugggaggugaggggcgccucugcccagccgccccuacugggaagugaggagccccucugccgggccagccaccccguccgggagggagguggggggcucagccccccgcccggccagccgccccaucugggagggaggugggggggucagcaccccgcccggccagccgccccauccgggagggaggugggggggucagccccccgcccggccagccgccccguccgggagggagguggggggggucagccccccgcccggccagccaccccguccgggaggugaggggcgccucugcccggccaccccuacugggaagugaggagccccucugcucggccagccgccccguccgggagggaggugggggggucagccccccgcccagccagacgccccguccgggagggaggugggggggucagcccccggcccggccagccgccccauccaggagggagguggggggggucagccccccgccuggccagccgccccguccgggagggagguggggggguccagccccccgcccggccagccgccccguacgggagggagguggggucagccccccgccgggccagccaccccguccgggaggugaggggcgccucugcccggccgccccuacugggaagugaggagccccucugccuggucagccgccccguccgggagggagguggggggucagccccccgcccggccagccgccccguccgggaggugaggggcgccucugcccggccgccccuacugggaagugaggagccccucugcccggccaccaccccaucugggagguguacccaacagcucauugagaacgggccgggaugacaauggcaguuuuguggaauagaagggggggaaagguggggaaaagauugagaaaucggaugguugccgugucuguguagaaagaaguagacaugggagacuuuucauuuuguucuguacuaagauaaauucuucugccuugggauccuguugaucggugaccuuacccccaacccugugcucucugaaacgugcuguguccacucaggguuaaauggauuaagggcggugcaagaugugcuuuguuaaacagaugcuugaaggcagcaugcucguuaagaaucaucaccacucccuaaucucaaguacccagggacacaaacacugcggaaggccgcaggguccucugccuaggaaaaccagaaaccuuuguucacuuguuuaucugccgaccuucccuccacuauuguccuaugacccugccaaaucccccucugcgagaaacacccaagaaugaucaauaaaaaaaauaaaaaauaaaaaaaaaaccauguaauuaaauauuguaaacuguggauucauuuaaaauaacagagaucuguauuuaccaauauggaaaacugcucaugguuaauuuuuuuuaaaagccaguuauaaaacagucuauuauauaaccccauuuucauuuaaguauuagaaggauauauacauacauguauauauucauauaaauuuauauauguguacagaaaacacauaccaaaauauuaauugguuauaucucugguuauaucuauaaaugaccuguuuccuuuuaagacuuuccuauuuuaaacuuuaugcaaugaacacacaaacuuccagucagaaaaaacguacuuuaaaaauguucaggcagggugugguggcucacgccuguaaucccaacccuuugggaggcugaggcaagcagauugcuugagcccagguguucaagaccagccuaugcaacauggcaaaacuccaucucuacaaaaaacgcaaaaauuagccaggcauggcagugugugccuguggucccagcuacuugggaggcuaaggugugaggcuaccuugagccuaggagguugaggcuacagugaacugugaucaucccacugcacuccagccuaggugacagagugagacccugucucaaaaaaaaaaaaagaucauuacauuugauuuuaaauauacacaaauucacauccauucauugaaguaauauuuucagaguaccuguggaacagguacuauggauacacaggggaacaagauaguaucuguucucaggaugauuaccaucuacugggaaagcagacaacacagauaauuguguuaccucauuugcuucacucuguugcuguuccuucuuuuuucuucuuuucucucuuuuuuucucauuuguaguugacuugcuuccuaaaguuugagacuuuccaguauuucgaccuuuaccuuuuccagguucagaaucagagccacugccacuauccacuuguaacagggcaaaacgagaagcgguggugggaacagaacuaaguacugcugaggccaucguaaagauuuuucuuuuaaaauacuucugucaagaauaauuucuguggggaggcagaagaguaggcagauggguaaacaaacagaguaaaaucuguuguagauucuaaaacaaccauauguagauaaaauaaauuucuucugacacuggauuuaguaaauuuggauuaauacccacagcacuauuagcaauaacauacuuuuauauuuaaguaaacgauauaacauuuuacaauagaaaaauaugagauuucacagauauaauguacucauuuuuccauguauacuuuaaaaauucacagucuuccucucucaaucauucugaaauauauacauaguuauagagaacauccuaaaucaauaugguuuacaguggaaaagaauaucauuuuuucaugauacacaaaaaaaagaccuuuaguccaacuacauguuaacucccaacuuccaauacaagaaaaaaaggaguaaagacggaauaccacucuuaucauauauaaaauacuaccauagguuugauucuagagacugugauuuagaacugacagcaaaaauaaagagcuuaaauucucucaaccaaaggaaacuuuucaaaaugccuuccacauuauguuuaguucacuaguuuccaugcaagcauaggucaguguagcuucauuccaugugcugucagcuuuuccacaaccguuuagacuuagaagggaucuuaaaaguccccuaguaguuccuaauccaaauccuuuaguuauacagcuaagguaaguggaguuuaaguugguuaugugacuucccuuaguucuuucuggaaguuagcggcugagucuccaccuggaccuagauuuguugaaccuuauucugaaaguccaaauuaagaagcccuguaacaaccagaagacuaagugcucuucuaauuaaaaaagacaaagauugucuuaacagaauggcaacucagaaauuuguauuuugaaauguuucagguaaaaacugaauauucaauuugaaaaaauuaagaugaacacuccaaguagccagcacaaagguuaacaaaacguuaacugacuccuaugcuucucuccaauugcauucccccacugcaccagccagagauaacaaguauccugauuuuuguauaacuuacuccuuugcuuuucuuuauaguucuauucuaugccuugauucacagugaucauauuugaaugaacugcugucauuuccacaauaucccacugguuacauauauauuucuuacuauauucacauuaucacacagguccacccuauucauugcaggaaagggcuauguaaaggugaauacuaagaaguaaggaucauuaagauccauucugaaagcuaaccacacauuaucguuuguauguuuucaggagggaagaaaaaugagaaguauguauucaaucuuccaccuuaaguaaccagaaaaauauuuggaaaucuuucaaguuuuugguauacaaugaagaaaaaucacaguaagaacugaugucugaagaugccaucuagucgucauuaagucauagcauuuuauuacaguaucauguuaagacaaauugcuagaaauaugcaaaucaagauaaaauaucacaauguacagagaugauaccacauugauaaaccgugacagauuuuuggcuccaaucuuuucuacaagcaugagaacgaaugcuucauaaguuacuacaaacaagaaaauguuucaaaauggaaaagaaauuccagaaauauuauggaaaagaugaauucugcuucaaccucaacauaucuuauuaaaauaaccuuauaggccgggugcaguggcucacaccuguaaucccaguacuuugggaggccgaggugggcaggucacuggaggccaggaguucgaaaccagccugggcaacauagugagacccugucucuacuaaaaauacaaaaaauuagccgggcauagugaugcaugccuguaaucccagcuacuccagaggcugaggcaugagaaucucuugaauccaggaaguagagauugcagcaaaccgagguugcacgacugacuccagccugagcaacggagucagacucucucucaaaaaaaaauaauaauccuauauaaaauuuuacuuucuugagcacucaagguacaauuauccuacauaguuguucaacuaucauuaauauucaauuuuaaauguugggacuauuaauugcaaguggcagcuguauuacuguucacaaauauucacugucucucccugaaggggaaugauacuauacaucacuucucuguugaaggcaggcauaaccagguaacuuacuuuggccagcgaaauauaaacuuuaaaaagcuuuacaagucagugugugguucaacauguucucuuuucccugcuucugcgauugcagaagcauauagugagauggaauuucuaucagccagaucuaauaaagucugcaaccacaaugaacaaagcccccuuacuaaccugugguggacaugguagcuugagcaagaaagcaacuuugcugcuuucagcugcugagauuuucagauugcuacugaagccuuaucaagacuuacaccuuacacaaaaaaauuucuucccauucuaggacugauaugaaaacugugaauuucauauauggauuauuugcaugcauuaaauguucauaaaugucuauucugaaacaucucuccaaggcucauagaaauuuucuuucuguagcauaaggcagagcuaucuuaccaggguauccuuagauaaaguuucccuuaggccuugggguagccaggaaaccccugaaaaaguaaaagccucuguuccagucacuuccagauacaagaaaccucauccggugcuccucaguggguagcuccugcacaugcugcucuggaguuaugucaacuaugaaaagggaagugcuccaaguccuaguaaucuaccucaucagacaacugcagaaugcacugcuacccauuaucauagacaggcuugugaaacuguuggaagauuauguucaaggugccuaaacagcaaggcacacaguagaauaagcagcaagucaagaaugggggagcccaaaaucuagugagcaagguuuccuuaaagcaacagccuuaaaucucuauauugauuauauuuuuacccauuugccagugacaugcauuuucagcagcaucaaaucuagcugcaaggugacugcucaaacaaugcauaugcuuucugucaccuagagcuuugucauuaaacacuugaaauuagaaaggucaauugaauuugaaauccugucauuugcuuauuuauucauuuguuuauuuuugagacagggucucgcucugucgcccaggcuggauugcaguaacaugauuauggcucacugcagccucgacuuccugggcuaaaaugauucucccagaucagccuccugaguagcugggacuaaaagugugugccaccaugccuggcuaauuuuuucuauuuuuuuuauagagaugggggucucccuauguugccuaagcuggucuccaacuccugggcucaagugauccuaccgccuuagccucccaaagugcugggauuacaggcaugagccaccgcaacugccccaaauccuuucauuuuuaucgcaagaaauuuucuauuacauuuuugaugaaaagagcuguuagauuauuuaaaaauaauuccaacuguuguaaauuauugaaugcuuagauaaaaauuguuuguuuuuauuaccuacucauacaaaugaaauuuuaauggguacucaauucuaagaaaucauuauuuaaaagucuagaucaggaacugaauauucuuauuucauggauaaacugauuuuaaaaugaaaaguuaauguucacagaagcaaguacaauucucucauuagaaacccugaaaagagucugaaguuuuauagaaauucaacauuuaguaucuuuccuauaaauuuauauuauguuuuacuuauccuauacuauaacaaaaacguuuuucacauuuuuuuccaucuaguucaguacagacaccuuuaaaucucuuuccaguuuugggagaaugagaugccucugguucuuuaugucaguaaugcaaaaggcaaauggcagggagcaccagcacaagaccacugaccuggagccagaaugcccaucacacccaacuuacuacuuaacguaaguacuugagcaaccuacuugaucucucuugaguuguuguaaagacugaauaaguuaauauacauaaaguacuuagaacaguagccagaagcauucaauacacucaagcaucacuuaaugauggggauacguugugagaaaugcaucauuaggugauuucaucauuguaugaguaucacacaguuuacuuacacaagccuaacugguacagccuacuauccaccuaggcuacaugguauggccuauugcuucuaggcuacaaaucuguacagccugugacuguacuggaggcaacuguaacacaaugguaaguauuuguauaucuaaagaaaagguacaauaaaaauaccacuuuauauauguccaucauugaccaaaacaaaacauaguuauugcagcacaugacuauauaagcauuuauggguguucuuacuauucuuauuagacugaaaugugccaugaggcgcuaugaggcauaggagaauugguacaaacuaucuaaaaauuugacuaagcaugccuaacuccauugaaaaguguuuugaaacuuuaucaacaucuggccccuauacaagcuaaggcuuuaaucuuugaaauaaaaaaguuuuuaggcauugaguaguaggugaguggucagccacugaaaagagucaaagaccuaaagauuacacauaacauacuacggaaggaaaauaccuaucuaccagaaacccaagagucacaguugagacuauaucuuaaauagugggcauacaauagauauuaaacguuucuugaaugaaugaaaagaaguaacaaaacaaacacaaagcaaacagaaaguauuaugacaaauacuguuaaucaagaaaagaaccaaugacaaacacucaaaagacaaaauuauuuuucugguaaagcagcuaccugugcuaugucacaucagcaaccuauguguuaacaugucugaaaggguacuucugucagaagguuacuucugaaaagcuaaaauggaaagggggaaaugccccuuuaaugaccucuuguuugaucaggguaaagugcaaaaagaguaagacaguggcagccacuucccauuauauuagacuuuacauaacaguaaauauuaaagacaaaaaauagcacuacuuaaucugcagcuaaggggauaggagaugaaacaacuggaagaguucaaucaucugugcuaugcuauacuuaaaaaaaaaaauagccaacauaucaacacaucaucuacugcaacagccuugacagaaaucuacauacuaugucaaaagguacaacgaccaguacuucagaaguagaagagaaggaaauguaauuuuaaaugaaagaagggaauaaaacuuaacaugaaaauaauccccaauuuguaaauaugucuauuauucauacacauaccaaaaugaagaaagaaaugcaugggauuacucacuaugcuuauuuuccuuucuaugguuuuuacuauuuccccaaauauucuacaaugacuauauaaauauauauauacacauauauauacacauacauacauacacacacacauguauacauauauacguauauauguauacguauauauacacauauauauacacauauauacguauauauauacguauacauauauauguauauauacacacguauauauauacacguauauauauauauauuuuuuuuuagacagggucuuacucacacaccaaggcuggagcaguggugugaucacggcucacugcagccucaacuuccuggucucaggugauucucccaccucggccuccagaguagcugggacuacaggcacgugacaccaugccuggcuaauuuuuugcagagacaggguuuugccauguugcccaggcuggucuugaaccccuaggcucaagcaauccuccuaccucagccucccaaagugcugggauuacaggaaugagccaccaugcccggcucuacaaugauauuaguucuaaaaaaaaaaaagaaaaacaaccucaaaaagaaaaaaugguuaucuauacucaaguugaaaaaguuaagcauaauguaaucaauacaauauugauuuuuuugcccugugucaaaauuuagaaagggcaacuacaggucagaauugacaaugagacgccuuuggccauucacaucagugacagacaagucaaacgacagagagcaacuaucgaagacuaauauguugcauacuuuuaagagaacacuacccucguuaacuaauuuuucagaauuuucaaaaagauagucauguuaugcaauccaggaauuccucuguaacuuuuuuuuuaaucuugauaagaagaaacaaauagggagacuaggaaaacauuaggcuuuuaaaagauacuauauuucaggucauggcuaggguuaguauuccuucagucuuguguccuaaacuucugcaucuccacauacagucacaucuaagagauguuaggauaaauagauucaaacacagcucuucucccucccucucuauacuuuuucuccuucaaauacacuuggucuuuaaaauuuagaugcuucuaugcuuagacauuuauauacacauaauauaauuaagccauacaaugcaaaugaaaauacaauggacugccaauuaaguuacuuaaauuagucuaugaauaugguggcuaauacuguauauuaaacauuuacauauuauuaaacuacuacacaaaucagguuuuuggugcagaaaucuaaugauuauuuuauuuauauuuuuccccuccucccuuugaguuccuuuuaaaaauaauuucaaggauaucugggcucaguggugcacaccuguaauuucagcaacuugggagacugaagcaggagaucacuuaaguccaggaguuugggaccagcccaggcaacauagcaaaaccguaucucauaaaauaaaugauaaaacuaauuucaaggauaauguauaguugaaggaagacaaaauaaauucacacgauaauuuuaaaaacagaaauguuucagggcaaaaugugaaauaaacacacauucucaauaugcaggcaguucaccauaaauaaauauaucuucuacuaucuuccauaauguaaugacuaccacuaguacaaacuauuaauuuauacuuaagauggcagcaggccacacauggugguucacaccuguaauccugguacuuuggaagggcugaggugggcagauugcuugagcccaggaguucaagaucagcuagggaaacauggcaaaaccccuucucuacaaaauguacaacaguuagcaggcauaguggugcaugacuguggucccagcuacuugggaggcuaaggugguaggaucaccugagccugggggucgaggcuguagugagcagugauugugccacugcacuacaccuuggguuacagccugagacccuuugucaaagaagaaaaagaaaaaaaaaagauggcagcaaugucaaaaauauaacaaagucuuuauuuuacauauacuucauacccaaaaagccaauuauuugacuuauuaaauguaauagcaugcguuagggcuuucucuagcaacccucuuucuucagauuuugcauguacuccaagaaaaaacaacuugaaauuucuugaacacacaauuaguuuacuuguucauaucuuuaacuaugcuguucucuuuugucuacaaugccaucuaucucuuccacugaaaacuuccauuuauuccucaaaauccugcucaggugcuagcauaucuaugaagcguucucugaccuguuccugaaguuaaacauucccuccucuguaauauuuccauacuuuaaacuuacuauuauugaauggacuccaaaaaaauucucuuuauuguugugccuagccccuaugauccugauuucaagauccugaaagacaagaguuucuaucccuuacaaauaccacaggaucuggcacauagaagacacauuuauugaacuuaguguuuucuucauguuuacauucuucaaguacacagcugucuaugcagugaaaaaugugcucuacaaguagaaaaagaaauaugugaagugcacaauagacaauccucaauucccauaacgcagaugugcaugagcaauuauuagcaguucaaaguuguuucauuacgguaaguacuauucuaacaaacuaauugccacaaccaauuuugucuaggaagcauaucugguuuuaaaguguugauuuaagccagccgggcaugguggcucacgccuguaaucccagcacuuugggaggccaaggcggguggaucacaaggucaagagaucgagaccauccuggccaacguagugaaaccccaucucuacuaaaaauacaaaaacuagcugggcaugguggcgcacgccuguagucccagcuacucgggaggcugaggcaggagaaucgcuugaaccagggagguagagguugcagugagccaagacugcgccaccacauuccagccuggcaacagagcgagagacugucucaaaaaaaugaaaaacuaaaguguuaauuuaagagaacuaggaugcauuggcugcuuaaguaaacugcuucuaaaaaugaauagccuaagcuacaagcaggagaauuuuuuuuuucucuuuguguauacauggggucucacuauguugcccaggcugaucucaaacuccugagcucaagcaauccuccagccucggccucccaaagggcugggauuacaggcaugcaccaccaagcccgacccaagcagaagaauuccuaaguggcugguagucuuggccucuaucaagguuuggaggcacauugccauuaugaccuuaucccucuacacuaugaccucacuagaaucaagacagcagcagccauaucucaguccagaagaccacaauuagggaacuucagaaaacacacacacacacacacacacacaauuauacauauaaaauccuuaaaucaagaacaaccaaauauauuacuuuuuaugagaugaaugauagccaucuucuauuaacacuaccaauuagccugaccaaaaaaagguauuaauguagaugccaauuaguguggccucacugaaauauaacuuagaucgaaauuaacugagcguaauaugaaauggcaccaaguaucacugauuuaacaccuggugaaauaaaaaauuguguuauuucauguucuguucuucagauaaccaaacaguaucuuucacuuuggcuucuuaaaaauuaggguucacaggccaggugugguggcucacacuuguaaucccagcacuuugggaggcagaggugggcagaucacgaggucaggaguuccagaccagccuggccaacaaggcgaaacaccgucuguauuaaaaauacaaaaaaaaaaaaaaaaaaaauuagccaggcgccuguaaucccagcuacucaggaggcugaggcaggagagcugcuugaaccuggaaggcagaaggugcugugagccgagaucgcgccauuacacuccagccugggcaacaagagcaaaauuccgccucaagaaaaaaaaaaaauaggguucacaaucagcaagugugaagugcauacuaaaacucugcuccaaacacacuuacuguaagugauguaaacccaauggguaugccccaaacuccauuuuuuucucauaguuaaguacugagaucccucuccaaucugcagcucccacuuucugcaggccaagaaaguuaaacaaaaaauacaagcagguacucagugaggaccugagggauucucccacgaguaaaauacaucuauuuucacacaagguucuuuuggucaacuucuggguuuugcucuuacuccagaauugaagcuacuauaguguuauaaaucuguugagaaaagaaaucuagacuucuaugaagauuuuuaauauuuuaauuugccaaaaagcuucucaaauauuuuuauagcuacaagucacauuuauuaaaugauuccaguuacaaucccaagcacauuuacuacacaacagacaaugcuaaauggugaagaaaagugucuccggcuuuuuaguguaagacagacgaucuuucauuaguucuucuaaugaaagcacuugcaucuacucugaaaaaucuggcgaagguaaagagugaaaaagaggaggaagagaaaaggcaaucagccaauuugauaaacuauuuuugucguuacuguucaauauuuaugaagcaccuuaaugcuagagaucugacaaaaauucgguaaggcuguuccaaacaauaacagaaaaaaaaaucacuuuucaauagcuggcgggggaggaggaggagcacuauauucaaaaaguaauucacuauaccucauucaugaaugaaagccaaauuucacccauaggcuguuaaccgaugcuccgaaacuuauucgcaaaguacauagagaaagaaauugcgcugggcgaaaccuaacucgggcagagaagcggcuucaaaaccugaaagggagaaaacgagucaggucguugcuccagaaauuuccgagcgcccggcuccccgggagggagcgcgggcgccagcggcggggaggggacgguggcaccugucacucgagcggcccccacggggucucgggaggcucagcggucgccggccugggagucgggugcgagucccuccccgccgccccgagccuugcgccgagcgucgggccgcggcccucccgugcccucugcccagcggcuccggucaguggggcccgucgccucaggccgaguccccgccacccgaggccggggcgccgaggggagcgcugucgagccgcugccuacgccuccggggugccggagcggacacccgcgaggcgggcccgccuccgcguacucaccgggccucccgugccgccggcucggcccuccucucccuccuccccccgccgccgccucucccgcggcuccccgggcggccgcacugggcguugggacuggucugggucaagugucggcagagcugggggcaggcucgcgccgggcgggggucgcggucggcccacaggcugggcacuaacgggucccggggcgccggggcggaccgcggaggugagcgcggcugcaggcugcggugaggggcggggagagcgcggcugagagcaggcgggcgggcggaggguggagggaagcccgggcggaggaggcggcgugagagccuc

SEQ ID NO: 192431 - RNA, 32445 nt, Homo sapiens
uuaaauuaaaauaaauuuuuauucaaagcaucuuuuaaaauuacagcauguuuauucuuaugcuguuaacucugccaaacuacaacuuagccauaugaagcauaaaacacuucaaaaauuugaauguaaaccauuuuuuaaaacaaaaagcagucuuaacacaccucaaauuuuagauaccaauguauuuuuccaaguauauagcuuauaucaaaaagaacauuuuaaauguuucuaaauaguugugauaauuucuuaaacuguugcaauuauacaaauaaaaaauguuuaugaaaaaacuauuagaguugacaaaagcugacuggagaaacaaggaaaaacccuuacuuuugaaggccuuaaauguuaucaucugugaauuggcaaauauuuguauuugaaaaauucuuacuacccuuccuucuuuaguuaaguugaucaaaguucaaauuucccaagacugaugaguguuguuuuuaguucauuaaaucacauauuugagagcaaaaauucuagaggaaaugcugaaacauaaaccaagauaauucagaugcuauagucucucuuaccagcuuauaagugcuccaaauuaaaauucuauauaccacauuacaaaaaaauucuuagaccauuacaaauauaaauucucuuauuacaaaaaaaucccuaaagauuuguaauuuacuguacagaggaauuacauuuuuaaaguauguccucaucauacacauuauucguaacuaucguaucuucuuucauacuuuuucuccucuucaagacauuuacaugccuccccuuccccguggcuacauauuuuaaacuaucuguguacuaugacacauugggauuuuuggauaaagaagccuacuuuguaauguuuaaacuacaucuguaggaacgucuucaacucaaaaaagcuaaaaaggcacugaagagcccauauuucccucuauuacucugaguuuuacuccaauuaagcgaucuguaaguuaccaugcuaugcaugucauuuaguucuguuuagaacaaaagccaaaaugauggaaguuuugccuacauaaaggagguggucugcucagcucuugauuuuucuguucaugcuucaguacauaaagugguguuuaauaacuuuauuuggaaaaauggcuucaaaccaccacacaaguuaacacacuugcaguuaaaacuauuucagaagccuacuuauuugaguagcuaauauuuucugcaguguuuaacugauagcuaaauuuagugaacacaaaauagcuuggcauguuacucugaaguaaagcaagaagguggcuuuaugcacugaaaauauaaauauggaggcuuccauuugcuaauaauucuaaacaagcaguacaauuaaaauguaguguuugcuaacaaaagaucuaaaacauuucacuacaaaacaacccugcaggugucccuuuaguaaaaauccaagugccaaaucucauuacagggcccuuaauauguauuuuuaaaauuaccaauuacuauguuaccuagacuuugcaagauuaaucacucaauuucagcaaaugagaaauaugaaaugugcaaaaguucccaaguuaacaugcuagggaugacaagugcuuuucaaacuuaaacauuauacugaguuguaaagccccagauagaauaagacugauuuugcuccaauuucaaaaauucugaacuauugugcaucuuaccaagagccucaaauaucuauuuucuucuaaguccauuacuuagaacaucuuccaaaauagccucccauuucucuagccuuagugggcacaguauuuugcaauuaaaauuaucuaucuuacauauuuuauacuuucuugcuugcuucaguguuuacaguauuguuaaacauacuaauauauauuguuaaaaaugaucuuauaaauaaucuguuuuaaucuucuuuggcuauuuguaccauucuguuuuucaaacaagugucuuauucagaaagugcuuccugugagaacugcuuccaaugaaugcauuaaacuugcaaaaucuagcuucccacaauauguaguuuucuacccuguacugugcaguccauauuuacaaaauauuuuaaacuuuacgaugaauucauuuccauauuaaaaaagugcaguucucucucaccccauauucuggggcaauaacauucuucauaaauuucuacagaauagcagccuaugauaagcaaauaaggugcuuagcuuaugcccaaggaucuacuuuuuaaguaugcugggcaguacuuuuguacaguggaagagucaguguccaagcuacugucggaguggcgccccagucagguuggcaagcucuaugagcgcgagggcuccaugcaggcgcucccgcugcuccugcagccggcgcugggccccucucuucucgucguccucuucaucagacugaagguauuccagaggguccugcugcuccugaucagccuucugaaccagcuugccuuucaaagugggggugcgcugcucucucauuucccaauaccuaugugaaaugcagcaacauuaguuacauggcagacaugaaauuuccaaauguuuacuuuucuuuuaaaaaguuccauaccacaauauuacuuuuaugugguucaguuuauaaaguuauaaagugauuuaacauaaauuuccuauuuauagaggaaagaaacugaaguucaacgagguuaagagacgugcucagguuuccacaauaaaccuggcaguucuagaucuucuacucacucucaaaucacguuuuugccauuaaacuaucaccgccuuaaagagccugugugaaauggacuugaguaaaauacagaaauaguagaaaaaacagucuuuagaaacuuauuuauccuaucuacagagggaugguaacuucugacagcguuaacgcuguaaauauuaaacccacaaacuaugaaaaagugauuaacaucugugacacagaguuuauucaaaaacuuaaaaacacuacccuuauucuguuacauggccaacugauaauuuacaagagaaaaugcaaaugcucaacucuuugguaacuaaagaaaugaguauuuaggcugggcgcaguggcucacgccuguaauccuagcacuuugggaggcaaggcaggcagaucacuugaggucaagaguucaaaaccagccuggcuaacauggugaaaaccccucuguacuaaaaauacaaaaaaauuugccgggcaugguggcaggcaccuguaaucccagcuacuccagaggcugaggcaggagaaugacuugaaccugggaggcggagguugcagcaagcugaagucgggccgcugcacuccauccagggugacagagcgagacuccguuucaagaaaaaaaaaaaaaagaaaaaugcauuuuaaaugacaguaacagaucauacaaaacuguccauacaaagccuuguauauuaauguucauaguagcuuuauauguaauagccaaaaauaacccaaaugcccaucgagagaauaaacaaacuacauuuguauaaaacuacuauuuuauagugacagcagaucaguguuguauggggggaagggggacagggaggaauguguaguucaguucacaaagggggcacgaagaaacuuggaaaugauggauauguucaccaucuugauuguggagauggugucacaguauauacaugucaaaaauguaucaaauuguauacuuuaaaauguauuaaacuguacacuuuaaauguaucauaauuucuuauaugcuacuuauauaccaacaaagcuguuuuuauuuauuuuuauuuuauuuuucgagacagagucucacuuugucacccaggcuggagggcaguggcacaaucuuggcucacugcaaccuucgccuccuggguucaaacuauucucgugccucagccuccugaguagcuggaauuauaggcgcccaccaccaugccuggcuaauuuuuuuuuuuuuuuuuuuuuuuuuggagacagaguuucacucuucuugcccaggcuagaguguaaugacgggauuuuaccauguugaccaggcuggucuugaucucccgaccucaggugaucugccugccuaggccucccaaagugcugggauuacaggcgugaggcaccgcaccaggccuguauuuuuaguagagauaggguccugccauuuagccaggcugaucuugaacuccugaccucaggugauccacccaccucagccaaaguguugggauuacaggcgugagccaccgcacccagccccaacaaagcuguuuuuaaaauuacauaccaaaaaaaaaaagaaauacaacuaccaaauuucaggaaauccagacuacuuaaaguggaaaaguuuuggcaaugcccacagaggucuaaaaaaagaaagugcaaauuguucaguaugacuugaaggaugacuagaagaggagaauggcaaaagauaaguucagcaagucagcaggaaccagguaaggaaggacuuugaauuccauaauaaaggguuuaggcuuuagacugaggaucauacugacauuuuagaaagaucccucuggcagcagcauggaaaauggauugagagcauucaaguggcugaauuugaguuaguaaggagguagaugucauaacuuggucacugaguagacagcagaaagacaaggaggcgaggugcgguggcucaugccuguaaucccaacaguuugggaggccaaggugcgagaaucacuugaggccaggaguuugagaccagcgugggcaacgugacaagacccagucucuacaaaaaacuuaaaaauuagcugggcaugguggcacacaccuguggucccagcuacucagggggcugaagugggaggaucacuugagcccaggaggucaaggcucaaugagcuaauaauccugcuacuacaguccagucuugacaacagaguaagacccugucucgaaaaaaaaaaaaaaaaaaaaaaagacaaggaugaccaguaagcuucuggcugggacacaauuagaaauaauggggcaguaggagcuaaccaggagaaagaggaggggaggaagugauggagauauuuaguuuaagguaccccuagaauuguccaucuaaacaauuucuaugacagugcuaacaaauuucccuggacgugaauaaucaaauaguauuuccagauuccauuauauaauucuuauguauuuuuauccaaacaaaacagaguuuauuccuucaaauauuuaucaaggcccagaagcucugcuaggcccuaggcuuaccauaauaaacaagacaaauaucccugcccggggaagcuuucagucuggcagggaagguauaaaauaaacaaauaaaugugugauggauguuuugaaaaggaaaaugaaagcaucuguuaaguuggucccagcccguuuguugcugagcaggucagggaggccuuccugaguaagagaugaaggugagcaagaggcuuagccaaguggggagugagugcuccaggcagaggaagcagggugcacacaggcccucauacaaaggcaccuguguugagaaacccacagcccagcauggcaggggacaguugccuuaucagagggaggcagggcuauggcagcacagcuaggaauccuggacuuuacccuaagcagccagugaagccugggugaggccugagcagcugcugcuggcucguguacagcagacaggcccuucaaccgaaauauccuuagagaaauucuuuuauacuggcccccuuguugccauuggaaaaaauuaaauugguguuuuuggaaccucaccuaagaagaaccacuaacaucuaucccugguguuuuuuuguuuuguuuugcuuuguuuugagacagggucucacucugucacccaggcuggaguacaagagugcaguggggccaucuuggcucacugcaaccuccgucucccaggcucaagcgauucuucugccucaaucucccgaauaacugggauuauaggcacgugccacuacugcccagguaauuuuuguauuuuuaguaaagaugggguuucacuaaguugaccagacuguucucaaacuccugaccucaggcgauccacccaccucggcugucuaucccuguuuuaauuggcacguagcuaaggcuaacauaaagaaaaugaaaaagguugcauucaugacgaaugaaauacaauacauauaaaacauuuuuucaaaauaggaaaacucuuccuuuuaaaauaaacuguagucugggcacucuaauuauauuguaauuuucuaucacacacagauccuaagauccuaauaccacucacaacaauuuuauagaaaaucaggggucauuucuaauuauguuauaaaauguguauaaaugcagcuuauuuaaaaugagaggcauguccaggucccugacauagccccagcccgcgcugugcaucuucacgguggacuaaaggcagcauuccugaccucgccagccacucggccgcggccuuguugucggcagccugauguuugcugaguguguccgugggcuccucucucuucagccuggcguaggggugcuucggacaguggcgguuugcaugggugaaucugcucaggcagccuucaaaacacaagguuaacaccugucaggaucuggacauccagcacauagacauguggaaaacauucaguuucacugguauccagaaaaguaaauuaauauggugaaauuuaggaucuauaauuuggaggagaaaacaaucaaaccagcacagucucaucagugcuagagcggggacaggaagacagucacauuuuggucguggccauguguguccaacaccauuggaaagugauuuauuagcaugaguucaaaauguucaaaauggcagggcgugguggcucacgccuguaaucccagcacuuugggaggccgaggcaggcgaaucacuugagaucaggagcuagagaccaaccuggccaacacggcaaaaugccaucucuacuaaaaauacgaaaauuagccgggugugguggucucugccuguaaucccagcuacucaggaggcugagacaggagaauagcuugaacccaggaggcagagguugccgugagccgagaucacgccauugcacuccagccuggcgacagagccagacuccaucgcaggggucggguggaguucaaaaccucagacccgagaauuccauuuguggauuccaacauaaggaagcaucccaaaagaugaacaaagcuacacgugugaaaacauuccccucagcuuuguugguaacaagaacauuuaaaaaacaaauuaaauauucagaccaggugcaguggcucaugccuguaaucccaacacuuugggaggccgaggcggguggaucaccugaggucagcaguucaaaaccagccuggccaacauggucccccaucucuacuaaaaauacaaaaauuagccggacaugguggcacaagccuguaauuccagcuacuccagaggcugaggcaggagaauugcuugaacucaggaggcgaagguuucagugagccaagaucgugccacuguacuccagccugggcgaaaagugagacuccaucucaaaacaauaaaaaauaaauaaauaaauaaaugcugggcgcaguggcucacgccuguaaucccagcacuuugggaggccaagguggacgaaucaccugagauugggaguucaagaccagccugaccaacauggagaaaccccaucucuacuaaaaauacaaaauuaacuggguauggucgcguaugccuguaaucccagcuacucgggaggcugaggcaggagaaucgcuugaacccaggaggcggagguugcggugagcugagauggcgccauugcacuccagccugggcaacaagagcaaaacuccgucucaaaaaauaaauaaacaaauauucauuauucaacauagaggaaaccauugcauauaggcuuaagcaaacuugcuggaugaaaacuuugcagacuuuugcaacauuuguaauaaucaagaaaauuacagagcaacaggacagauugcacggaacuucaaauauacuguaacugcauaaaaaugugcaucuuuagaaacugauaaaagauuaagaaaaucacuuaggauaauaugcuuacuucacuuuaauaauuaaaaaguuuaaaauguugcuccaaaggcuguauuuacuuuuacagauuuuucuacugccuacaacuggauauaguaucuuuaauugcccuuuaagguuucaucaaaaaggauuacuuuauuuaaaaaucaauuauuucuuaagccaggcacagaaagacaaacaucacuuguucucacuuauuugugggaucuaaauaucaaaacaauugaacucguggagauagacaguagaacaauggugcccagaggcuaggaaggggaacugggggaugaggggcagguaaggaugguuaauagguaccaaaaauagaaagaaugaauaagaccuaguauuuuauagcacacggugacuauagucaauaauaauuuaacuguacauucuaaaauaaguuaagaguauaacgggauuauuuguaacacaaaggacccaugcuugagaggauggauagcccauuuaccaugugauuauuaugcauugcaugucuguaucaaguaucucauguacccuguaaauauguauacguacuguguacccacaaaaaucaaaaccaacaaauuuuuaaaaucaaucauuucugagaaauucagcauguaucacaauuaucaaagaagaaagcuuauaaaguuuuauaaaauuuauauuaaaaaaucuuuccccucaaaaaaauucaaggaaaggauauuuuaacuguuaagucacaacuaguuauuccauaaacuuaacuucuaacaccguaccauuuucugaacaaacaaaagguuucucuccggugugaagacgcugauguguuuugagcuguccacuuugaacaaaggcuuuuccacagucuggauagucacacagauagggccucucaccuaaguagacagauguuagauauuauaucugagauaauaaggccagaagaggagggggauggggagagaaucagccuuuauauaggucaugacucccaauaacaauaaaacaugucauggccccuacugagcugcagguggaaaugcuaauggcagcacuuggguggcaucaaugacuaucugcuggggaacacaaucuauucuuuaggccuugagguuaucaucuugagcuuaucccauauuuuuucucccucauacuccaaaucacuagaucuugcugauucuucacuaugucuuccacccacuccugccuucccacucagcuuccccuggucagacgggcagcccucccacuaggaugaacccuccgacagccuccuggccggccucuuguuucucccccugcacagcaaucccagaguagcuggcauagaaaucugcuuuugucauaccaacuagcuccugaaccacccccaaauccuauuacacaccuuggacaacuaaaaauuaucugcugacuuaaaugguccucuaagaucggcacucuaggcaaucucaccaaccucauuagcuacugggguuaaggggcagaguuuauccuuacuucccuccuggagaaucauuccagccaggaggcaguuccucaucuuguucuaauccuugaaaauccuauuuucucugcccauucaaaucuucccaauccuguaggcucucagugagauucuuccuaucuccccaaauaacugaauucuuccuaucuaccuccaaauaauugaacuuuguauaccuucauuaaccugggguccuguguuguuuaugugucaugguagucuccugcaaagauuccuaguaccuuauacuucacuuaaauuccuauagacaacacagugccaggcucaagugcugaaaaauuuguuaaugauaauuaaacauuauuuauugaaaaaaacauuauuuaaucaacaauuguacauuaguuugcauuuuccaguauaacucaaagaauaacaaguccucccuaaauuucucauuauuuagagacauaauaaaugguugugauaguugaauacaaguuaaaauaaaacacagauauagggggauuguuuaaaauaguaagggaaaagcuuuuuacaaaauaugcuaauagggcucaacuaucccuuagggauccuccuuucaguuccuugauguacagacaucuaggcugaugccugggguaucaggugacacagugagguaguggugaucaggacggcacucagcccuuucuucauucugccacauagucuugaaucuuacccacacuggcaacucuacggccuacaaaccaguuauccaggggauauuuuagaauauuuagauugaaaaaaauauauaaaaauucucaaaauuagaauguuucauuaaguaaucauuuuacuaaugguauccaaagucaaaacuucuagacaccuuaguuuauaaugauuuaaaauucaaacauuaccccuuuccagggauuuaacuuaaaaaaaaccucuauucuaucauaucauuuaaauauauauuuucaaaaaccacaaguuaaaaaaaagugagaaacaggugagcaccauaaacaugguggaaaaaaauaggggacugaggguuacaggcuuaaguucuaaaccaguacugcccaaugaaagacaauaugaaccacuucuagaaggcacauuagaaaaaguaaagagaaagaggugaaauaaauuuuuuuuuuuuuuugagauugaguuuuguucuuguugcccaggcuggagugcaaugucacaucuuggcucaccgcaaccuccaccucccggguucaagugauucuccugccucaguuucccgaguaacugagauuacaggaaugugccaccacaccuggcuaauuuuguauuuuuaguagagauggggucucuccauguuggccaggcuggucuugaacuccugaccucaggugauccacccaccucggccucucaaagugcugggauuacaggcgucagccaccgcacccagccaugaaauuaauuuuaauaauguauuuuauuuaauccaauuuaucuaaaagugucauuucaauacauaaucaacaguaaaaauuauuguuuacucuuuuuuucauauuaaguauguuuuauauuacugcccaucucaauuuagacuacccacauuucaagugcucaggagucacaguggcuacuguauggggcaguguagcucuagcuuuaaagguaugagagacugauuguaagccgguaguaguuggauuuuuggcacuucaguuuccucaccuguaaacuauuagaugaacuauaagguuccuuccuuuggggccaacuuuauagcgagaacaagggcccucuauacuuuuuuuuuuuggcucucuaaaugauauuuaaaaugcaaauauaauuuccauaugcaaauaaagauguaccauaaucuugagauggcugccuaccauaguucaccacagauuuaaugcuuaggucaaauguccugauagcacagugaggacucuaaacauucuauuaaaaacuugacaauuaauguuuuuggccuacagaugaauuuuaacaauuacauagauaaaaguauaucaaguacaauuugggcaaguaggggguaaaacuaaauuugccaauaacaugacuaugacaucuagguuaauuaccaugauaacuuuagaaaucacauguaaccaguauucauaaaaccaccacucuccaccaaaaagaaacugacuauacugccuuuuuaaaaaacuucacaacuaauagugguaauaagaaaauauaaagcaacuaaaaaguuaauuuauuacucaauaucaaaucagcauucaguuaaguguuacuucuggccaggcgcgguggcucacgccuguaaucccagcacuuugggaggccgaggcaggcggaucacaaggucaggaguucgagaccagccugaccaacauggugaaaccccaucucuacuaaaaauacaaaaauuagcugggcgugguggcacacaccuguaaucccagcuacucaggaggcugaggcaagagaauugcuugaacccaggaggcggagcuugcaguaagccaagaucgcgccacugcacuccagccugggcaacagagcgagacuaucucaaaaaaaaaaaaaaaaaaaaaaaaaaaaaaaaaaaguguuacuucuggcagucucuauaaaauuugcucaacuuaccuguaugaguccuuuugugagccuggagcgauuucucccguggaaacacccuauuacagauguuacaacggauucugcuggaugaaugcucuccuucauuuauuaaaucgcggacaguaucugcucugggccuaccacgucggauuccauccuguugauaauuuuuauaaacauuaauauaauuuauuuaacgcuacucauuaaagcaacguaucauaauauaacuuucaaaaaucuuucuugggagcugggcgcagcggcacacacuuauagucccagcuauuuaggaggcugagguaggaggaucacuugaggccaggaguucgaagcaacauagcacaaaacauuuuuguuuugucucuaaaaacaaagcaaaagccuuucuuaagggacaucaguaaaaauggugaggcagguaacuccaauggcccaucccuccacagaugacuaaaaaaucaagcaaaaacugucagaucagcuuugucacaacuccagaaaauacauuuauagcaacucagcaaacugaauaaaaaagcaacuugaaacaguagaaaagcuuugcagcauuuugacuugcccucucucuuucccuuccccaguggcagucuugaagacagcagccugcauucucagucugggaaccuacuccuuuagucccugcuuccagaggaagaaauucugaaagaauugcguuugccuguuuugagccugcggguuaccuaaaggacugacacaagacauuggucuuugcuuucccuaacuuggaacagggcagagaggugucucuucagaggguauugcucaaaaaacuuguaaggcaaauaaucugcagccaccuggggcaaaagauuucaguugaagcaaacagacacaccaacagccugagaggaaaagcugggagaaaguuucuuuuggaaauuugggcauucaacaauguccacuuauacuaagguuaggaauuuagaaagucaugcauauaugcccagggcaggaagcaugcucagaaaagaucugaaaagacccuuuagcugaacuuucggcucagcacaagcaggaaaugaggcuacaguagaguuguaaacagcagggcuaagcaaccacagugucccccaacacagccauucugcaaagacugggagaaggugguuguccuccuuucugucuacucuuuuuugggggaugguggagggaagcucuagguauucaaaaaagucugucaaaacacuagugguggcucagccuauaaucccagugacucaggugggaggaucacuugagcaaaggaguucaaggcuacagugaguuaugaugccccugcacuguagccugagugacagagugagaccccaucucuaaaaaacaaaaaacaaagugucgggcgugguagcuuacgccuauaaucccagcacuuugagaggcugaggccaguggaucaccugaggucaggaguucaagaccagccuggccaacauggcgaaaccccaucucuacuaaaaauacaaaaauuagccaggcauaguggcacacaccacuagucccagcuacucaggaggcugacgcaggagaauugcuugaacccgagagguggagguugcagugagcugagaucgcgccacugcauccuggccugggugacagagcaagacuccaucucaaaaaaacaaaaaacaaacaaacaaagcaucagcugaacacaggcuaagaaagagacuuuagagaacaaacacaacaaagaacacagaauuuagaaagaguuuagaacacucacuaaacaacuacaacucauagcaaacaacaaaaacucagaaggaagggucugauuuccggagucacauuauaauauucaaaaccuccaguuuucaacaaaauguuacaaagcaugugaagaaauaaaaacaguaugguacauacacaggagaaauuaacacaaagagucugagaagaagaacagacacuggacuuacuagacaaagauuuuaaaucaacugucuuaaauguguucagugagcuaauggaaaugauggacaaagaacaagaagccuggguaacauagcaagacccccuuucuaaaaggaauaaaaauaaauuagccaggcaugguggcacuucucccaagcuacuugggaggcugaggugggagaauuacuugacccugcaaggucaaggcugcagugagccaugauuacaccacugcucuccagccugggcaauagagcaagacccugucucaaaaaaaaaaaaaaaaaaaaggaaaagaaaaaggaaaaagaaugacaagaaaccaggagaacaaugucucaacaaacagaaaaccaacaaagagacagaaauuauaaaaaagaaucaaauagauauccuggagcugaaacauacaauaacuaaaacaaacaaaaaaaaaacuucacuagaggauuucaguggcagauuugaacugauagaacaaucagccaacuugaagauaggucaguugaauuuauccagucugaagaacagaaagaaaaaagaaggaagggaaaucaacagagucuaagaugccuauggaacaccaucaagcauaccaacauacauauaacuggagucauagaggcaagagaggaaagggaaagaauauuugaagaaauaaugacagaaaacuucccaaauuugauaugacacaaaucuaaacauccaagaagcucaauacacuucaagaaaaauaaagggauccacaccaagacauuuuguaaucaaacugucaaaugacaaaaagaaucuugaaagcagcaagaaaguagugacuuggauaagcaccauggcucaagccuauaaucccaacacuuugggaggccaaggcaggaggaucacuugaauccaggaguuugagaccagccugggaaacguaaggagaccucaugucuacaaauaauuuaaaaauuauccaaguguggggguacacgccuguggucccagcuacucaggaggcugaggaaggaggaucagcugagccugggaggucaaggcugcaaugagccaugaucgcgccacuggacuucagccuggggacaaaacaagaccaggccucaaaaggaaaagaaagugguucaucauguaaaagggguccucgauaagauuaacagcugauugggaggccagggugggcagaucacaaugucaggagcucgagaccggccugaccaacauggcgaaacccugccucuacuaaaacuacaaaaauuaggccgggcacguggcucaagccuguaaucccagcacuuugggaagccgaggcgggcagaucaccugaggucaagaguucgagaccagccucaacauggagaaacccugucucuacuaaaaauacaaaauuagccgggcaugguggugcaugccuguaaucccagcuacucgggaggcugaggcaggagaauuacuugaaccugggaggcagagguugcggugagccaagaucgcaccauugcacuccagccugggcaacaagagcgaagcuccgucucaaaaaaaaaaaaaaaaaaaaauuagccagguguaguggcgcacacuuguaaucccagcuacucaggaggcugaggcaggagaaucgcuugaaccugggagauggaguuugcaguaagccaagauugcgccccugcacuccagccuggcagacagugugagaugccaucuccaaaaaaaaaaaaauuuuuaaauuagcaaggugcaguggugugugccuauagucccagcuacucaggaggcugaggcaggaggaucacuugagcccaggaguucaaggcuauagugagcuaugaucacaccacugcacuccagccugggcaacagagcaagacccuaucucuuaaauuucagcacuuugggaggcugaggugggcaggucaugaggucaagagaucaagaccaaccuggccaacauggugaaacccugacucuacuaaaaauacaaaaauuagcugggcaugguggcacgcgccuauagucccagcuacucaggaggcugaggcaggagaaucacuugaacccagaaggcggagguugcagugagccgaguucgcaccacugcacuccagccuggcaacggagcuagacuccaucuccaaaaaaaagaaagaaagaaacaaaagaaaagaagaaagaacugugaaaggacagaaaaacuuauaacuuuuagaaauauauauacaccuaagaacagagccuccugcaaaaggugacagaauuaaaaggagaaauaguucaaaaacagcuggagucuucgauacccuacuuccuuuacuucuuucuuucuuuuuuuuuuuuuuuuuuuuuuuuugagacagguucucacucuuguugcccaggcuggagugcagugaugcagucucagcucacugcaaccuccaccucccagguucaagcgauucuccugccucagccucccgaguagcugggauuacaagugcccaccaccacgccuggcuaauuuuuuuuuuuuuuuuuuuuuuuuuuguauuuuuaguagagacgguuucaccuuguuggccaggcuggucuugaacuccuggccucaagugauccgcccaccucggccucccggaguguugggauuacaggcgugagccccugugcccaguuaauacccuacuuucaauaaugaauaagacaacuaggcagaagauccacaaagauauucuccaacauagaccauacguuagaccacaaaaaagucucacuaaauuuuaaaagacugaaagcauuccaaguaucuucucugaccucauggaaugaaacuuuacagaaggaaaacaggaacaaauauauagaaauuaaacaacacacuuuuuuuuuuuugagacggagucuugcucuguugcccaggcccgagugcaguggcaugaucucagcucauugcaaccuccaccucccagguuccagcaauucuccugccucagccuccugagcagcugggacuauaggugugugccaccauacccagauaauuuuuguauuuuuaguagagacaugguuucaccauauugaccaggcuggucuugaacuccugaccucgugauccacccgccuuggccucccaaagugcuggaauuacaagcaugagcccccgugcccagcccaacacacucuuaaauagccgaugggucaaagaagaaaucacaagggaaaaaagaaaauaccuugacacaaauaauaccaaaaacacaacauaccaaacuuauaggauacaauucaagaauuagaugacuuaaaauugauaagauagcaaugcuauccaaagcaaucuuacagccacaaugcaaucucuauuaaaauuccagggguuuuuuuucuuuuuuuuucuugcagaaauggaaaaggcuauccucaaguucauauggaauuauaggaggcuccaaauagccaaaauaaucuugaaaaagagaacaaaacaggaggacucacacuucccaauuucaaaacuuacuacuaagcacuggcaauuaagacagugugguaauggcauaaggaaagacauauagaccaaugaaauaaaauuuagaguacagaaccuaaccuauacaugaaaggccaauugauuuucaacaagggacccaagaacauucaacagagaaagaauagucucuuuaacaaaugguucugggauaacuggauuuccauauacaaaaggauaaaguuagaccccuaccuuacacuauauacaaaaacuaacucaaaauguaccacagagcuaaauauaagaacgaaaacuauagagcucuuagcuggacacgguagcccaugccuguaaucccagcacuuugggaggccaagguggguggauuguuucagcccaaaaauucgagaucagccugggcaaccuggugaaaucucauuucuaccaaaaauacaaaaaguuagcagagcaggguggcacaugccuggagucccagcuacucaggaggcagagguugcagugagccaagaucaugccacugcauuccagccugggcaacagagugagacccugucucaaaaaaacaaaaacaaggccgggcgcgguggcucacgccuguaaucccagcacuuugggaggccgaggcgggcggaucacgaggucaggagaucaagaccauccuggcuaacacgaugaaaccccgucucuacuaaaaguacaaaaacuuggccaggcgcaguggcucacgccuauaaucccagcacuuugagaggcugaggcgaguggauuacgaggucaagagaucgagaccauccuggcuaacauggugaaaccccgucucuacuaaaaauaaaaaaauuagccgggcgcgguggcgggcaccuguagucccagcuacucgggaggcugaggcaggagaauggcgugaacccgagaggcagagcuugcagugagccgagaucacgccacugcacuccagccugggcaacagagugagccaagaucacgccacugcacuccagccugggcaacaaagcgagccuccgucuccaaaaaaaaaaaagacuguaaugcucuuaaaauaaaaacagggaugacucuucuugacuuuguauuuuuuuaauggauucuuagauauggcaccaagagcuaagcaacaaaagaauaaauuggacugaaucaaaauguaaaacuuuuguacaucacaggacauuacaaagaaaacgaaaggccauccuacagaaugggagauauuuauuugcaaaccauacaucugauaagggccuaguaucaaggauauaaaaagaccucuuagaacucaacaacaacaaaaaacacaaaaaacucaauuaaaaaauaggcaaaugacuugaacagacauuucuccaaagcaguuauauggccaacaaaugcaguuauauggccagcaaauacauaaaaagaugcugaaaaucagccacaugcaguguaucacgccuguaaucccagcacuuugggaggccaagguggguggaucaccugaggucaggaguucaagaccagccuggccaacauggugaaaccccguuucuacuaaaaauacaaaaauuagucaggcaugauggcgagugccuguaaucccagcuacucaggaagcugaggcaggagaaucgcuugaacccggagguugcagugagccgagaucacaccacugcacuccagccuggccaacuaagcaaaacucugucucaaaaaaaaaaaaaaaaaaaaaaauccucaaaauuauucaucauuuaggaaaaugcuaauugaaaccacaaugagauacugcuuugcaccaacgagguuauacuauacugggagaaaaaaaggaaaauaaguaggaaauaguuuuuuuauuaaaaauguagagaaauuggaaccaucauauacuacugaugagaauguaaaauggcucagccacuguggaaaaguuugauaguuuuguaucgauaucauauauauauacauauacauacacaauggaauauguauacauauauaaugaaauuauucagccaugaaaauaauauaugcuacaaaguggaugaaccuaaaaaacaguaugcuaaaaaaagaagccaaacacaaaaggcgacauauuaugugacuucauuuaaugaaauauccagaauagguaaauccauagagacagaaaguagguuguugguuuccaaggucugcauguaguagggaacagggaaucguggucuaacagaucaaguuuucuuuagaggugauaaaaauguuuuggaacucuuagaacauuaugaauguacuaaaugucacuagauuguacacuuuaaaaugacuaauuuaauguuauguaauuuuacauugauuaaaaaccuaaggaaaucugaauaugcuaugggauucaguuaauacuagugcaucaacauugguucauuaauuuuuaacaaauguaccacauuaguguaagauguuaacagggaagcugggugugcaguuuaugggaacucucuguacuaccuucacagcuuuucuauacagcuaaaacuaauauaaaauaaacauuuacuugaaagaaacuuuguuucccaguuaagugaacuuucacacauacaaguuacaugaaaaaaaaucauaaaaggaucauauacaacuacuucuaaaaugaagaugcuuuuagggcuuucaauaucaaaacucaaagccuuccaaaagcuuaaacaucagccugaaaccuugaaggauaguaauaagcuacagcaaaauucccuucaaucaaauuuucacauugaaagaaaaguucaaucccuacauggaugaauuaucuucuaggauaaaucauguuuuaugaaaauccuuagauauuaaaaucuauauucagcacaacuuaaugaccugauuucagucuuauaccaugaauauucaaauuaguuguacacuuacuacuuuuauucugaaagucuaaagaaaguuuucaaaagauuuaaugaagucuuuaccuauuuuuccuuuagucuuuagauucaggcagcguacuaaacaggaacaccuaaaaauuauuaauaacugaagaaauauguuuuauguugguaaauucucauuagccauuacaguuaacuuuuuuaaugauuaagaccgugggggccgggcacgguggcucacgccuguaaucccagcacuuugggaggccgaggcaggcggaucacgaggucaacagauugagaccauccuggcuaacacagugaaaccccaucucuacuaaaaaaauacaaaaaauuagcugggcgcgguggggggcgccuguagucccagcuacucgggaggcugaggcaggagaauggcgugaacccgggaggcagagcuugcagucagccgagaucgcaccacugcacuccagccugggugacagagcaagacuccaucucaaaaaaaaaaaaaaaaaaaaaaaaaaagaacgugggggucaggcacaauggcucacaucuguaauccuagcacuuugggagucugaggugauagggucgcuugaggccggaaguuagagaccaaccugggcaacauagcaagaccccaucucuauuauuaaauaaauaaauagcuuuccugucccggccugcguggcgugggcuugugggucuuugagacccgaaaauugagagcauuuucgcaccccaggggcugcuccuggcggcucugcggccgucaccaugccacagaacgaauauauugaauuacaccguaaacgcuauggauaccguuuggauuaccaugagaaaaagagaaagaaggaaagucgagaggcucaugaacguucaaagaaggcaaagaaaaugauuggucugaaggcuaagcuuuaacauaaacagcgccaugcugagaaaauauaaaugaaaaaaagacuaucaaagaugcaugaaaagaaaaacaccaaacaaaagaaugaugaaaagacuccacagggagcaguaccugccuaucugcuggacagagagggacaaucucgagcuaaaguacuuuccaauaugauuaaacagaaacgaaaagagaaggcgggaaaaugggaagucccucugccuaaaguacgugcccagggagaagcagaaguauuaaaaguuauucgaacaggaaagaaggcauggaagaggauaguuacuaacgugugcuuuguuggagauggcuuuacaagaaaaccaccuaaauaugaaagauucaucaggccaaugagacgggguuucaccguguuagccaggauggucucgaucucucugauccgcccgccuuagccucccaaagugcuggaauuacaggcaugagccaccgcgcccggccaacgugaguaauuuuuaauagauuaaaauauuggcaaauagccuguuucuguaaauaaaguuuuaauggaacacaaaauaaauaaauaaauaaauaaauaaauaaauaaauaaacguuggacacaggaaggggaacaucacacaccgggccugucgcgggguggcgggagcggggagggauagcauuaggagauauaccuaauguaaaugacgaguuaaugggugcagcacaccaacauggcacauguauacauauggaacaaaccugcacguugugcacauguacccuagaacuuaaaguauaauaaauaaauaaauaauaaauauuuuuuaaaaaacaaugugggaaggcuacauauacaaaagaaaugaaaacagaaucucaaagacauauuugcacaucuguguucauugcagcauuauucacaaucgauagcaacccaaauguccacugacugaugaauggauaaauagugcuauauacaguuuagccuaagcaaacucaguguguuaguaacaauggaaaacuacucagccuucagaaagauggaaauccugccauaugccauaacauggaugaaccuuuaggaaauuaugcuaaguaaaacaaaccagugacaaaaaggcaaauacugcauaauuuuaccuauaugagguaucugaggucaucaaacucuuagaagaguggugguggccagggacuagagaggggcgggggaaaggcaaguucagugaguauagaguuuguuuuacaagaugaauaaauucuagggacuuguugcacaaccguuuacauauagucaacacuacuguacuguauacuuaaaaaugguuaagguagaaaauauuaucggguuuuugccacaauuuuuaaaaugucagaaggcacuguggcagauauuauugcaaaaacauucacugccccuuucacuguggguccagagugcaacuuagccauaugacuugcuuuggccaauaaaaugugagugaaaauagccuguguaguuuggauguuuguccccuccaaaucucauguugaaauuugauccccaguauuggaggcggagccuaguggaacgugucugggucauaaagacagaucccucaugaacaucuagacgcugugcucgcucauauuguuaccaugagaucugacuguuaaaaaaagccugucacuuccuccccucccucuuguucccucucucaccaugugaaaccugcuccccuucgccuucugccuugauucgaagcucccugaggucccucaccagaagcagauucuggugccaugccucugguacagccugcagaacuacaacccaaauaaaccuauuuuccucauaaaucacccaccuucagguauucuuuuauagcaaugcaaaauggacuaauacaacauacgguucuaccaucucuguuuucucucugcuuugagacccaucugucccagcuuggagagauuccuucaggauccuagaaugaacagaauguggagcacaccaguggucaacccucccaggacacauaacaugagccauguugaggcugagauugccaucuugaaguugcauucugcagccugcuuuuuagccugagcuaacugacucaguggguuaguaacgaauaucuguugaugaaacaaaaagcucaucaaccuuacuuaauuacucaagaaauucccaugcauaaugaaacaggaauuagcaagauccuaauggaccaugacuuauuaaaguacaaauuaacaaaucaacuucuggccaugauugguggucaucaaauucuuucaucuucuuuacuccuuggcugugauccucaguagccacauauagcucaagucuugcuugcuaaaauuauuaacacagagucagacagaaggagcuacacaggagugaaaucuucauugccaucauuuauuaagccacaauaauuucauggauuauugcugguuauggucauaucaugaauaauuguuuuaauaaguacaaaauaaauauaaaagaauauagcaucugugaucaauaaaaauaggagcugauucuguuaagaaagaaacagaacaugaaaucaggacaauuaaaaaccacaggccaggcgcgguggcucacgccuguaaucccagcacuuugggaggucgagguggguggaucacgaggucaggagauugagaccauggugaaacccugucucuacuaaaaaugcaaaaaauuagcugggcgcaguggcgggcgccuguagucccagcuacucgggaggcugaggcagaauggcguggaccugggaggcggagguugcaguggccgagaucgcaccacugcacuccagccugggcgacagagugaaacucugucucaaaaaaaaaagccauaggccuggcugggcgugguggcucacgccuguaaucccagcacuuugggagaccgaggcggguggaucacgcggucaggagaucgagaccauccuggcuaacacggugaaaucccgucucuacuaaaaaauacaaaaaauuagccgggcgugguggcgggugccuguagucccagcuacucgggaggcugaggcaggagaauggcgugaauccaggaggcggagcuugcagugagccgagauggcaccauugcacuccagccugggcaacagagagagacuccgucucaaaaaaaaaaaaaaaaaacaaaaaaaaccauagaccaggcacgguggcucacgccuguaaucccaacacuuggggaggccgagguggguggaucacaaggucaacagaucgagaccauccuggccaacauggugaaaccccgucucuacuaaaaauacaaaaaaaaauuagcugggugugguggcacgcgccuauagucccagcuacuugggaggcugaggaaggagaaucgcuugaacccgggagacagagguugcaguaacccgagauugcaccacugcacuccagccuggcaacagagcgagacucugucaaaaacaaaacaaaacaaaacaaaacaaaaaaaacauaguggcuggccacaguggcucacgccuguaaucccaacacuuuuaagaggccaaggcaagaggaucacuugaacucggaauucaagaccagccuggacaacauagugugacuccaucucuacaaaaaaaaaaaaaaacauagccaggugugguggcauacaccuguggucccauacucaggaggaucacuugaacccgauaggccaaggcggcagugagccaugauugcgccacuguacuccagccugggcgacagagaccuugucucaaaacaaacaaacaaaaaaaccuuagugauacaaguccucugccauaaaaggaucccuuuccuaguauuuuuacauauguaagaaaggcugggcgccguggcucaugccuguaaucccacugcuugggaauuugaggcaggagaauugcuugaguccaagaguuugagaucagccugggcagcauagcaagaccccugucuacaaaaaaaaaaaaggccaggugugauauacaccugaagucccagcuacucaggaggcugaggugggaggaucacuugaggcugaggugggaggaucacuugagagugggaguucaaggcugcagugagcccuaacagugccacugcacucagccugggugacagagugagacuucgucugaaaaacauaaaaaauaaguaaacaaauaaauaugcaagaacauauugcugacuuuugcaauuugaaauaacugauuaguuaacauaaaaaaaaaaguuaaccauauggcugccucccagcaacucuaagagacuguuucugccaccagcaacacauuuauauuuuccaaaugagaaauggagugagugcugaaauauacagcauaauacaacauacuggccauauacagggaaggguucacuaagugcauucuuuuggguuuuuuuguuuuguuuuuguuuuuugagauggacucuggcucugucgcccaggcuagaguacaguggcaugaucucagcucacugcaaccuccgccuccuggguucaugcgauucuccugccucagccucccaaguagcugggacuauaggcaagcgucaccaugcccagcuaauuaauaagugcauuauuuuagcucagaaaauaagacaaaacaaauaaucauauaaugcccuaaauaaaugaauaaagaccaucuuuuaacaauacauauuaaaauaagcaauguuacuuaaagaggacccucuuccuuuuggccuuaacaaugagaaaaccauguuucuaggcaucuucggacaauuacagaguguuacacucagcagccaagugcaccuggaggcuaaggacagaucuugucaagacuguugacgauucgcaacacaaaauuauuaaauugccaaaaacuuuugcauaccuuaguaauuauaauuuuaaaaacaaucuccauaccucuagaagguugauuagugauuuugaaaguguuuagucaugugauaacuaaaaaaccuaaaaguccuugacacauuuuuauaaguagaauucaaauaaagggaacaagcacaaccuagaaggaaaacaaaaauaggucucagagggaggcgugugaaccuuuucacauucagauuuagauacaaacuucccaugacuugcauacaugcuuccuaacuuguaacuaccuacuucccauccugaccuaucuucacaacuucucaaguuuuaauuccaguuuauugaauugagugcacuuuuauaaagcaucucaauugagacauagauaagcuauacauaguauguauuucuuuuuucuuuuucuuuucuuuuuuuuuuuuuuuugagacagaaucucgcuuagucgcccaggcuggagugcaguggcacaaucucagcucauugcaaccucugccucccggguucaugugauucucaugccucagccucccgaguagccgggacuauaggugugcaccaccaugcccagcuaauuuuuuuguauuuuuaguagagacaggguuucaccauguuggccagguuggucucaaacuccuggccucaagugauccauccaccuuggccucucaaagugcugggauuacaggcaucagccagcaugcccggccaauaguauguauuucuuaugucuacuuaucucagcuuaauauuuaaaaaacaaaaauaaaccccugaagucuauuuacaugugauagucccaggagcagugcaguauagggacuaagaacagggacucuagaagguuccgaucaguucugccacuuaccauacaaucuuaacuagauuuugucuuggggacucuaauuucucauuccucaucagguaaacaggauaaaaugaauuaaagaauucaaaaugcucaacacagagcccagcaguuugcugcuaacauuaugaaaugcuuacucugugccaggcaauaaauagugccuacuauguuaacaugauguuagguuuaacauggugcucaaacauuacuauucauaaauacuaugaauuuauguauuauguauaaaguauuuaaaaaucagcuauucguaacaguauguacagucuagguuuugaaguguucaggugacacagaaaggggaaguaggauacggcagccgguagauccuguagggugaauaguaucugagaagccagaccccaccagccccagugaagaaguaacuucaaaugcagucuuaguagagggcacagggacaagguggggagccuuggaacaacuuguggcagaaggcaguuagaccugcuuucuucccucucagaauucuacaauccagaagaagauaauauauaauuauaugccaacagugcuaagcacucgugugaugagcagccaaaauaagcuaguagguguucccacaggcgagggaggcaguguugggcaggaacaaucaaaagagcaagagaaagcugacacagggugugcaggacucagacgcugacaccuccccugggagaaguggcaaagaauagacaguaaaugaacgcaaauauuguucucaaacccacagcuguuagugccucuauguggcauauugggagaauguuauuggcacuggcuauauugcagacuugucuccucucuuccccaaaaaugagcagacucagcacaauucccugaugaugcacauggagauaaggaacuacaaguacuuuaaagaagcaaaacaguaaaacaggcugggacucucuaucuuuguaguucaguguacugaccacaaaucaaacuaagcaacuuccuuauuuuuuucuuuuuccuucuugcccccacaaagcuuagucuagcuagcaacuuucuuaaauaaagguguauuccagacccuucugucuuacggugggaaagcuaaauaaaugaauuuuuggagcugcauguggauugcuucaucaauagaaagacauauucaaaucaauuuaccaaauaauuuaugaaaguuacaacaggaaaaacuacaugagaaaagaaaaaagcagaaauauaaaacagccauuucacuuuuacauguuuuuuacaaccguugguauacuuuaccucugaaaagagguguacagcauggaaauacaauucaaacccaugcaucuuguuagcaauuuuuuuuuuuuaagacggagucucacuguggccaggcuggagugcaguugcacgaucucggcucacugcaaccuccgucuccaggguucaugugauucuccugccuuagccucccaaguagcugggacuacaggggugugccaccacacccagguaauuuuuguauuuuuaguagagacaggguuucaccauguuggccaggauggucucgaucucuugaccucgugaccagccagccucggccucccaaagugcugggauuacaggcgugagccuccgcgccuggccacaguuagcaauuuuuauaaaaugucuggguaaggacaagucuguuuuaggccaaaaacaacauaccuauagauuucaucuauauaacauuaaucuucuugggugauccagaacuagauuaaucuauaagaauaaaaccauaaaggcaaaaucuuacacaagaacuuaugaauguaugccuuuauauuguucaacuacauaaucuaauuuaguguuuuuuuuaaaagacuaaaacuuauaaaugguuaacacaaaaauaccuaggauacccauccaaauuuuuuuuuuuuuuuuucugagacagagucuugcucugucgcccaggcuggagugcaguggcacgaucucggcucacugcaagcuccgccucccggguucacgccauucuccugccucagccucccgagcaggugggacuacaggcgccagccaccaccccuggccaauuuuuuuuuuuuuuuuuuuguauuuuuaguagagacgggguuucaccguguuagccaggauggucucuaucuccugaccuugugauccgccugccucggugucccaaagugcuuggauuacaggcgugagccacccacccgguggauaccgauccaucuuacaucucacuaggggauaccuagaggcagcccaacagcaacuguagccuuuaguaauacucagcaauacuaucaacgcuucuaucguuaguuucuucauuuuuuuuuuuuuuuuuuuuuuuuuuuuuuuuuuuugagacggagucucacucugucccccaggcuggagugcaauggcgcaaucucggcucacugcaaccgccgccucccgaguucuaccaauucuccugccuuagccucccaaguagcugggauuacgggcgcccgccaccacguccggcgaauuuuuauauuuuuaguagagacaggguuucaccauguuggucaggcuggucucgaacuccuggaccucaggugauccacccgccucagccucccaaagugcugggauuacaggcgugagccaccgcaccuggcaaguuucuucaauuuuuguuaaagaguugaggucuugcuuugucacccagacugaagugcaguggugcuaucaugucucacuguagccucaaacuccuggucucaagugauccuccugccucagccucccauguagcuacguauauaggugcaggccgccagaugcggucuauguugcccaggcuggucuugaacuccuggucucaagugauuccccagccucagccuccugaagggaucacaggcaugagccaccucaccaggcucuguuaugguuuuuuuuuuuguuguuuuuuuuuuuuuuuuuugagacggauucucgcucuuuugcacaggcuggagcgcaguggccugauuucaguucccugcaagcuccgccucccgcuucacgccauucuccuaccucagccucccgaguagcugggacuacaggcgcccaccaccaagcccggcuaauuuuuuguauuuugaguaaagacgggguuucaccguguuagccaggauggucuugaucuccugaccucgugauccgcccgccucugccucgcaaaguucugggauuacaggcgugagccaccgcacccggcccagguucuguucuuucaaauguuuacugaggugcaguuucaagagcugaaguguauaaaaaccuauaguuuuauaaccuuauaauuauuuaauaauaaugccacauaaaauauaucaauuuccucaaaacccaaacaauguaguuucaacauccuugugacugcauguaaaaugaucaaacucguuucaacuuauacauuaugugcugauacagaugcaguuauccacuaugugauuuacuuguuaucucuugcaaauugcuuaucuuauacagccacuuaacaaauggaaccuggauauuacccuucuguuagcaccauucauucauuacacaaauauuuuuugagcaccuuuauugagcauuuacagaauguaagguaguaaagucauauagucuucuagauagaaauacuccuggcucaccuggagcuuacagucuacagaguucaguauaagucagcagaaagucaccccaaacacaugcaggacuaaaagccacaaaaccucgaccuaguccccgcucuuccacuacugagcugugccaucgugggaaggucgccucacuaaucacuguaagccccagcugccugaucuguaaaauagguuugaaccagugguaacgaccuucccagcuuuaagcagucggagacugcaagcaauuuuagcgucccauuccacuaugugcucucaacaccuagcaaguaguaugcuggauaaaugaaaggcagcgaaggcacaacuucagccgcagaacaggcccagaaguccuuucuugcucuucggcugucucugcagggcaucuuuuaacagggcgagggcgaucugcaguaauggagcaaacacugugcgcucccugcccucucgcagucgguggaacaacucaaggcccucaucccucucguuuccucucggaacugaggacucggcagcccgccgggaggaugucaguggccguugacccggccuccccagcgaccccgggccgcgcucccgcccacugcaccugccgcaaggacggucucccgcgccgcucccgccugucacgugacaggccccccccgacuggggccgguuuuuggcgcgcggcagugacgucagcauccugucagccgcagcccccgccguagccggaucgaccucgcguuuucaacuccgccccgcccgccgcaccguuaacgggccccggcugccccacgucccgcccgcccgcccgcccgcgccgcucaccuugagguggccgcugucugggcugcucgcuuccuccucguccucaccucccgaggcggcggcggaggccgaggcggcgggcgggggcgcgccccggccacgaagccccgagugcucggcggcugcggcugcaggcagggcggccgaggcggcggcccccgcggccccagggcugagcgucacguugugugcguucucgccccagcgccacggguacaccaugaagucgcugaagccggggcugguggggaugagcggcggcggcggcuccggcuccccuccaccgccgcacguuggcuugaucggggucguccugaugaccgacaccagcacccgcuucggggagucguggcagaagaugacgggcggcggcggcggcggcggguucuccgccaugggcgccucgaagccccggaucaucgcccggcccgacccccagcuccggcggccccgggccgcacuccugagcaccgcucugccccucacucgcucugcuccgagucgcaggcucaguccugccggcucauggcagacugacguuucccggaauccugcgcagcagccaccuaacuaguugagcagacggcaccggcgggcagggcuggaccccagccccaggucaagcgcgcccuccgcucuuuguacuccgcagcgcaggcugcaggggugggaagcagcgggcggcccggcccuugcggugacaggaaagcaggacgcgcggcgcugagcccccaaaaauaacaaccugccgccgcggugccugccccggcuuuuc

SEQ ID NO: 192432 - RNA, 32445 nt, Homo sapiens
gaaaagccggggcaggcaccgcggcggcagguuguuauuuuugggggcucagcgccgcgcguccugcuuuccugucaccgcaagggccgggccgcccgcugcuucccaccccugcagccugcgcugcggaguacaaagagcggagggcgcgcuugaccuggggcugggguccagcccugcccgccggugccgucugcucaacuaguuagguggcugcugcgcaggauuccgggaaacgucagucugccaugagccggcaggacugagccugcgacucggagcagagcgagugaggggcagagcggugcucaggagugcggcccggggccgccggagcugggggucgggccgggcgaugauccggggcuucgaggcgcccauggcggagaacccgccgccgccgccgccgcccgucaucuucugccacgacuccccgaagcgggugcuggugucggucaucaggacgaccccgaucaagccaacgugcggcgguggaggggagccggagccgccgccgccgcucauccccaccagccccggcuucagcgacuucaugguguacccguggcgcuggggcgagaacgcacacaacgugacgcucagcccuggggccgcgggggccgccgccucggccgcccugccugcagccgcagccgccgagcacucggggcuucguggccggggcgcgcccccgcccgccgccucggccuccgccgccgccucgggaggugaggacgaggaggaagcgagcagcccagacagcggccaccucaaggugagcggcgcgggcgggcgggcgggcgggacguggggcagccggggcccguuaacggugcggcgggcggggcggaguugaaaacgcgaggucgauccggcuacggcgggggcugcggcugacaggaugcugacgucacugccgcgcgccaaaaaccggccccagucggggggggccugucacgugacaggcgggagcggcgcgggagaccguccuugcggcaggugcagugggcgggagcgcggcccggggucgcuggggaggccgggucaacggccacugacauccucccggcgggcugccgaguccucaguuccgagaggaaacgagagggaugagggccuugaguuguuccaccgacugcgagagggcagggagcgcacaguguuugcuccauuacugcagaucgcccucgcccuguuaaaagaugcccugcagagacagccgaagagcaagaaaggacuucugggccuguucugcggcugaaguugugccuucgcugccuuucauuuauccagcauacuacuugcuagguguugagagcacauaguggaaugggacgcuaaaauugcuugcagucuccgacugcuuaaagcugggaaggucguuaccacugguucaaaccuauuuuacagaucaggcagcuggggcuuacagugauuagugaggcgaccuucccacgauggcacagcucaguaguggaagagcggggacuaggucgagguuuuguggcuuuuaguccugcauguguuuggggugacuuucugcugacuuauacugaacucuguagacuguaagcuccaggugagccaggaguauuucuaucuagaagacuauaugacuuuacuaccuuacauucuguaaaugcucaauaaaggugcucaaaaaauauuuguguaaugaaugaauggugcuaacagaaggguaauauccagguuccauuuguuaaguggcuguauaagauaagcaauuugcaagagauaacaaguaaaucacauaguggauaacugcaucuguaucagcacauaauguauaaguugaaacgaguuugaucauuuuacaugcagucacaaggauguugaaacuacauuguuuggguuuugaggaaauugauauauuuuauguggcauuauuauuaaauaauuauaagguuauaaaacuauagguuuuuauacacuucagcucuugaaacugcaccucaguaaacauuugaaagaacagaaccugggccgggugcgguggcucacgccuguaaucccagaacuuugcgaggcagaggcgggcggaucacgaggucaggagaucaagaccauccuggcuaacacggugaaaccccgucuuuacucaaaauacaaaaaauuagccgggcuugguggugggcgccuguagucccagcuacucgggaggcugagguaggagaauggcgugaagcgggaggcggagcuugcagggaacugaaaucaggccacugcgcuccagccugugcaaaagagcgagaauccgucucaaaaaaaaaaaaaaaaaacaacaaaaaaaaaaaccauaacagagccuggugagguggcucaugccugugaucccuucaggaggcugaggcuggggaaucacuugagaccaggaguucaagaccagccugggcaacauagaccgcaucuggcggccugcaccuauauacguagcuacaugggaggcugaggcaggaggaucacuugagaccaggaguuugaggcuacagugagacaugauagcaccacugcacuucagucugggugacaaagcaagaccucaacucuuuaacaaaaauugaagaaacuugccaggugcgguggcucacgccuguaaucccagcacuuugggaggcugaggcggguggaucaccugagguccaggaguucgagaccagccugaccaacauggugaaacccugucucuacuaaaaauauaaaaauucgccggacgugguggcgggcgcccguaaucccagcuacuugggaggcuaaggcaggagaauugguagaacucgggaggcggcgguugcagugagccgagauugcgccauugcacuccagccugggggacagagugagacuccgucucaaaaaaaaaaaaaaaaaaaaaaaaaaaaaaaaaaaaugaagaaacuaacgauagaagcguugauaguauugcugaguauuacuaaaggcuacaguugcuguugggcugccucuagguauccccuagugagauguaagauggaucgguauccaccggguggguggcucacgccuguaauccaagcacuuugggacaccgaggcaggcggaucacaaggucaggagauagagaccauccuggcuaacacggugaaaccccgucucuacuaaaaauacaaaaaaaaaaaaaaaaaaauuggccaggggugguggcuggcgccuguagucccaccugcucgggaggcugaggcaggagaauggcgugaacccgggaggcggagcuugcagugagccgagaucgugccacugcacuccagccugggcgacagagcaagacucugucucagaaaaaaaaaaaaaaaaauuuggauggguauccuagguauuuuuguguuaaccauuuauaaguuuuagucuuuuaaaaaaaacacuaaauuagauuauguaguugaacaauauaaaggcauacauucauaaguucuuguguaagauuuugccuuuaugguuuuauucuuauagauuaaucuaguucuggaucacccaagaagauuaauguuauauagaugaaaucuauagguauguuguuuuuggccuaaaacagacuuguccuuacccagacauuuuauaaaaauugcuaacuguggccaggcgcggaggcucacgccuguaaucccagcacuuugggaggccgaggcuggcuggucacgaggucaagagaucgagaccauccuggccaacauggugaaacccugucucuacuaaaaauacaaaaauuaccugggugugguggcacaccccuguagucccagcuacuugggaggcuaaggcaggagaaucacaugaacccuggagacggagguugcagugagccgagaucgugcaacugcacuccagccuggccacagugagacuccgucuuaaaaaaaaaaaauugcuaacaagaugcauggguuugaauuguauuuccaugcuguacaccucuuuucagagguaaaguauaccaacgguuguaaaaaacauguaaaagugaaauggcuguuuuauauuucugcuuuuuucuuuucucauguaguuuuuccuguuguaacuuucauaaauuauuugguaaauugauuugaauaugucuuucuauugaugaagcaauccacaugcagcuccaaaaauucauuuauuuagcuuucccaccguaagacagaagggucuggaauacaccuuuauuuaagaaaguugcuagcuagacuaagcuuugugggggcaagaaggaaaaagaaaaaaauaaggaaguugcuuaguuugauuuguggucaguacacugaacuacaaagauagagagucccagccuguuuuacuguuuugcuucuuuaaaguacuuguaguuccuuaucuccaugugcaucaucagggaauugugcugagucugcucauuuuuggggaagagaggagacaagucugcaauauagccagugccaauaacauucucccaauaugccacauagaggcacuaacagcuguggguuugagaacaauauuugcguucauuuacugucuauucuuugccacuucucccaggggaggugucagcgucugaguccugcacacccugugucagcuuucucuugcucuuuugauuguuccugcccaacacugccucccucgccugugggaacaccuacuagcuuauuuuggcugcucaucacacgagugcuuagcacuguuggcauauaauuauauauuaucuucuucuggauuguagaauucugagagggaagaaagcaggucuaacugccuucugccacaaguuguuccaaggcuccccaccuugucccugugcccucuacuaagacugcauuugaaguuacuucuucacuggggcugguggggucuggcuucucagauacuauucacccuacaggaucuaccggcugccguauccuacuuccccuuucugugucaccugaacacuucaaaaccuagacuguacauacuguuacgaauagcugauuuuuaaauacuuuauacauaauacauaaauucauaguauuuaugaauaguaauguuugagcaccauguuaaaccuaacaucauguuaacauaguaggcacuauuuauugccuggcacagaguaagcauuucauaauguuagcagcaaacugcugggcucuguguugagcauuuugaauucuuuaauucauuuuauccuguuuaccugaugaggaaugagaaauuagaguccccaagacaaaaucuaguuaagauuguaugguaaguggcagaacugaucggaaccuucuagagucccuguucuuagucccuauacugcacugcuccugggacuaucacauguaaauagacuucagggguuuauuuuuguuuuuuaaauauuaagcugagauaaguagacauaagaaauacauacuauuggccgggcaugcuggcugaugccuguaaucccagcacuuugagaggccaagguggauggaucacuugaggccaggaguuugagaccaaccuggccaacauggugaaacccugucucuacuaaaaauacaaaaaaauuagcugggcaugguggugcacaccuauagucccggcuacucgggaggcugaggcaugagaaucacaugaacccgggaggcagagguugcaaugagcugagauugugccacugcacuccagccugggcgacuaagcgagauucugucucaaaaaaaaaaaaaaaagaaaagaaaaagaaaaaagaaauacauacuauguauagcuuaucuaugucucaauugagaugcuuuauaaaagugcacucaauucaauaaacuggaauuaaaacuugagaaguugugaagauaggucaggaugggaaguagguaguuacaaguuaggaagcauguaugcaagucaugggaaguuuguaucuaaaucugaaugugaaaagguucacacgccucccucugagaccuauuuuuguuuuccuucuagguugugcuuguucccuuuauuugaauucuacuuauaaaaaugugucaaggacuuuuagguuuuuuaguuaucacaugacuaaacacuuucaaaaucacuaaucaaccuucuagagguauggagauuguuuuuaaaauuauaauuacuaagguaugcaaaaguuuuuggcaauuuaauaauuuuguguugcgaaucgucaacagucuugacaagaucuguccuuagccuccaggugcacuuggcugcugaguguaacacucuguaauuguccgaagaugccuagaaacaugguuuucucauuguuaaggccaaaaggaagaggguccucuuuaaguaacauugcuuauuuuaauauguauuguuaaaagauggucuuuauucauuuauuuagggcauuauaugauuauuuguuuugucuuauuuucugagcuaaaauaaugcacuuauuaauuagcugggcauggugacgcuugccuauagucccagcuacuugggaggcugaggcaggagaaucgcaugaacccaggaggcggagguugcagugagcugagaucaugccacuguacucuagccugggcgacagagccagaguccaucucaaaaaacaaaaacaaaacaaaaaaacccaaaagaaugcacuuagugaacccuucccuguauauggccaguauguuguauuaugcuguauauuucagcacucacuccauuucucauuuggaaaauauaaauguguugcugguggcagaaacagucucuuagaguugcugggaggcagccauaugguuaacuuuuuuuuuuauguuaacuaaucaguuauuucaaauugcaaaagucagcaauauguucuugcauauuuauuuguuuacuuauuuuuuauguuuuucagacgaagucucacucugucacccaggcugagugcaguggcacuguuagggcucacugcagccuugaacucccacucucaagugauccucccaccucagccucaagugauccucccaccucagccuccugaguagcugggacuucagguguauaucacaccuggccuuuuuuuuuuuuguagacaggggucuugcuaugcugcccaggcugaucucaaacucuuggacucaagcaauucuccugccucaaauucccaagcagugggauuacaggcaugagccacggcgcccagccuuucuuacauauguaaaaauacuaggaaagggauccuuuuauggcagaggacuuguaucacuaagguuuuuuuguuuguuuguuuugagacaaggucucugucgcccaggcuggaguacaguggcgcaaucauggcucacugccgccuuggccuaucggguucaagugauccuccugaguaugggaccacagguguaugccaccacaccuggcuauguuuuuuuuuuuuuuuguagagauggagucacacuauguuguccaggcuggucuugaauuccgaguucaagugauccucuugccuuggccucuuaaaaguguugggauuacaggcgugagccacuguggccagccacuauguuuuuuuuguuuuguuuuguuuuguuuuguuuuugacagagucucgcucuguugccaggcuggagugcaguggugcaaucucggguuacugcaaccucugucucccggguucaagcgauucuccuuccucagccucccaaguagcugggacuauaggcgcgugccaccacacccagcuaauuuuuuuuuguauuuuuaguagagacgggguuucaccauguuggccaggauggucucgaucuguugaccuugugauccacccaccucggccuccccaaguguugggauuacaggcgugagccaccgugccuggucuaugguuuuuuuuguuuuuuuuuuuuuuuuuugagacggagucucucucuguugcccaggcuggagugcaauggugccaucucggcucacugcaagcuccgccuccuggauucacgccauucuccugccucagccucccgaguagcugggacuacaggcacccgccaccacgcccggcuaauuuuuuguauuuuuuaguagagacgggauuucaccguguuagccaggauggucucgaucuccugaccgcgugauccacccgccucggucucccaaagugcugggauuacaggcgugagccaccacgcccagccaggccuauggcuuuuuuuuuugagacagaguuucacucugucgcccaggcuggagugcaguggugcgaucucggccacugcaaccuccgccucccagguccacgccauucugccucagccucccgaguagcugggacuacaggcgcccgccacugcgcccagcuaauuuuuugcauuuuuaguagagacaggguuucaccauggucucaaucuccugaccucgugauccacccaccucgaccucccaaagugcugggauuacaggcgugagccaccgcgccuggccugugguuuuuaauuguccugauuucauguucuguuucuuucuuaacagaaucagcuccuauuuuuauugaucacagaugcuauauucuuuuauauuuauuuuguacuuauuaaaacaauuauucaugauaugaccauaaccagcaauaauccaugaaauuauuguggcuuaauaaaugauggcaaugaagauuucacuccuguguagcuccuucugucugacucuguguuaauaauuuuagcaagcaagacuugagcuauauguggcuacugaggaucacagccaaggaguaaagaagaugaaagaauuugaugaccaccaaucauggccagaaguugauuuguuaauuuguacuuuaauaagucaugguccauuaggaucuugcuaauuccuguuucauuaugcaugggaauuucuugaguaauuaaguaagguugaugagcuuuuuguuucaucaacagauauucguuacuaacccacugagucaguuagcucaggcuaaaaagcaggcugcagaaugcaacuucaagauggcaaucucagccucaacauggcucauguuauguguccugggaggguugaccacuggugugcuccacauucuguucauucuaggauccugaaggaaucucuccaagcugggacagaugggucucaaagcagagagaaaacagagaugguagaaccguauguuguauuaguccauuuugcauugcuauaaaagaauaccugaaggugggugauuuaugaggaaaauagguuuauuuggguuguaguucugcaggcuguaccagaggcauggcaccagaaucugcuucuggugagggaccucagggagcuucgaaucaaggcagaaggcgaaggggagcagguuucacauggugagagagggaacaagagggaggggaggaagugacaggcuuuuuuuaacagucagaucucaugguaacaauaugagcgagcacagcgucuagauguucaugagggaucugucuuuaugacccagacacguuccacuaggcuccgccuccaauacuggggaucaaauuucaacaugagauuuggaggggacaaacauccaaacuacacaggcuauuuucacucacauuuuauuggccaaagcaagucauauggcuaaguugcacucuggacccacagugaaaggggcagugaauguuuuugcaauaauaucugccacagugccuucugacauuuuaaaaauuguggcaaaaacccgauaauauuuucuaccuuaaccauuuuuaaguauacaguacaguaguguugacuauauguaaacgguugugcaacaagucccuagaauuuauucaucuuguaaaacaaacucuauacucacugaacuugccuuucccccgccccucucuagucccuggccaccaccacucuucuaagaguuugaugaccucagauaccucauauagguaaaauuaugcaguauuugccuuuuugucacugguuuguuuuacuuagcauaauuuccuaaagguucauccauguuauggcauauggcaggauuuccaucuuucugaaggcugaguaguuuuccauuguuacuaacacacugaguuugcuuaggcuaaacuguauauagcacuauuuauccauucaucagucaguggacauuuggguugcuaucgauugugaauaaugcugcaaugaacacagaugugcaaauaugucuuugagauucuguuuucauuucuuuuguauauguagccuucccacauuguuuuuuaaaaaauauuuauuauuuauuuauuuauuauacuuuaaguucuaggguacaugugcacaacgugcagguuuguuccauauguauacaugugccauguuggugugcugcacccauuaacucgucauuuacauuagguauaucuccuaaugcuaucccuccccgcucccgccaccccgcgacaggcccggugugugauguuccccuuccuguguccaacguuuauuuauuuauuuauuuauuuauuuauuuauuuauuuuguguuccauuaaaacuuuauuuacagaaacaggcuauuugccaauauuuuaaucuauuaaaaauuacucacguuggccgggcgcgguggcucaugccuguaauuccagcacuuugggaggcuaaggcgggcggaucagagagaucgagaccauccuggcuaacacggugaaaccccgucucauuggccugaugaaucuuucauauuuaggugguuuucuuguaaagccaucuccaacaaagcacacguuaguaacuauccucuuccaugccuucuuuccuguucgaauaacuuuuaauacuucugcuucucccugggcacguacuuuaggcagagggacuucccauuuucccgccuucucuuuucguuucuguuuaaucauauuggaaaguacuuuagcucgagauugucccucucuguccagcagauaggcagguacugcucccuguggagucuuuucaucauucuuuuguuugguguuuuucuuuucaugcaucuuugauagucuuuuuuucauuuauauuuucucagcauggcgcuguuuauguuaaagcuuagccuucagaccaaucauuuucuuugccuucuuugaacguucaugagccucucgacuuuccuucuuucucuuuuucucaugguaauccaaacgguauccauagcguuuacgguguaauucaauauauucguucuguggcauggugacggccgcagagccgccaggagcagccccuggggugcgaaaaugcucucaauuuucgggucucaaagacccacaagcccacgccacgcaggccgggacaggaaagcuauuuauuuauuuaauaauagagauggggucuugcuauguugcccagguuggucucuaacuuccggccucaagcgacccuaucaccucagacucccaaagugcuaggauuacagaugugagccauugugccugacccccacguucuuuuuuuuuuuuuuuuuuuuuuuuuuugagauggagucuugcucugucacccaggcuggagugcaguggugcgaucucggcugacugcaagcucugccucccggguucacgccauucuccugccucagccucccgaguagcugggacuacaggcgccccccaccgcgcccagcuaauuuuuuguauuuuuuuaguagagaugggguuucacuguguuagccaggauggucucaaucuguugaccucgugauccgccugccucggccucccaaagugcugggauuacaggcgugagccaccgugcccggcccccacggucuuaaucauuaaaaaaguuaacuguaauggcuaaugagaauuuaccaacauaaaacauauuucuucaguuauuaauaauuuuuagguguuccuguuuaguacgcugccugaaucuaaagacuaaaggaaaaauagguaaagacuucauuaaaucuuuugaaaacuuucuuuagacuuucagaauaaaaguaguaaguguacaacuaauuugaauauucaugguauaagacugaaaucaggucauuaaguugugcugaauauagauuuuaauaucuaaggauuuucauaaaacaugauuuauccuagaagauaauucauccauguagggauugaacuuuucuuucaaugugaaaauuugauugaagggaauuuugcuguagcuuauuacuauccuucaagguuucaggcugauguuuaagcuuuuggaaggcuuugaguuuugauauugaaagcccuaaaagcaucuucauuuuagaaguaguuguauaugauccuuuuaugauuuuuuuucauguaacuuguaugugugaaaguucacuuaacugggaaacaaaguuucuuucaaguaaauguuuauuuuauauuaguuuuagcuguauagaaaagcugugaagguaguacagagaguucccauaaacugcacacccagcuucccuguuaacaucuuacacuaaugugguacauuuguuaaaaauuaaugaaccaauguugaugcacuaguauuaacugaaucccauagcauauucagauuuccuuagguuuuuaaucaauguaaaauuacauaacauuaaauuagucauuuuaaaguguacaaucuagugacauuuaguacauucauaauguucuaagaguuccaaaacauuuuuaucaccucuaaagaaaacuugaucuguuagaccacgauucccuguucccuacuacaugcagaccuuggaaaccaacaaccuacuuucugucucuauggauuuaccuauucuggauauuucauuaaaugaagucacauaauaugucgccuuuuguguuuggcuucuuuuuuuagcauacuguuuuuuagguucauccacuuuguagcauauauuauuuucauggcugaauaauuucauuauauauguauacauauuccauuguguauguauauguauauauauaugauaucgauacaaaacuaucaaacuuuuccacaguggcugagccauuuuacauucucaucaguaguauaugaugguuccaauuucucuacauuuuuaauaaaaaaacuauuuccuacuuauuuuccuuuuuuucucccaguauaguauaaccucguuggugcaaagcaguaucucauugugguuucaauuagcauuuuccuaaaugaugaauaauuuugaggauuuuuuuuuuuuuuuuuuuuuuugagacagaguuuugcuuaguuggccaggcuggagugcaguggugugaucucggcucacugcaaccuccggguucaagcgauucuccugccucagcuuccugaguagcugggauuacaggcacucgccaucaugccugacuaauuuuuguauuuuuaguagaaacgggguuucaccauguuggccaggcuggucuugaacuccugaccucaggugauccacccaccuuggccucccaaagugcugggauuacaggcgugauacacugcauguggcugauuuucagcaucuuuuuauguauuugcuggccauauaacugcauuuguuggccauauaacugcuuuggagaaaugucuguucaagucauuugccuauuuuuuaauugaguuuuuuguguuuuuuguuguuguugaguucuaagaggucuuuuuauauccuugauacuaggcccuuaucagauguaugguuugcaaauaaauaucucccauucuguaggauggccuuucguuuucuuuguaauguccugugauguacaaaaguuuuacauuuugauucaguccaauuuauucuuuuguugcuuagcucuuggugccauaucuaagaauccauuaaaaaaauacaaagucaagaagagucaucccuguuuuuauuuuaagagcauuacagucuuuuuuuuuuuuggagacggaggcucgcuuuguugcccaggcuggagugcaguggcgugaucuuggcucacucuguugcccaggcuggagugcaguggcgugaucucggcucacugcaagcucugccucucggguucacgccauucuccugccucagccucccgaguagcugggacuacaggugcccgccaccgcgcccggcuaauuuuuuuauuuuuaguagagacgggguuucaccauguuagccaggauggucucgaucucuugaccucguaauccacucgccucagccucucaaagugcugggauuauaggcgugagccacugcgccuggccaaguuuuuguacuuuuaguagagacgggguuucaucguguuagccaggauggucuugaucuccugaccucgugauccgcccgccucggccucccaaagugcugggauuacaggcgugagccaccgcgcccggccuuguuuuuguuuuuuugagacagggucucacucuguugcccaggcuggaaugcaguggcaugaucuuggcucacugcaaccucugccuccugaguagcugggacuccaggcaugugccacccugcucugcuaacuuuuuguauuuuugguagaaaugagauuucaccagguugcccaggcugaucucgaauuuuugggcugaaacaauccacccaccuuggccucccaaagugcugggauuacaggcaugggcuaccguguccagcuaagagcucuauaguuuucguucuuauauuuagcucugugguacauuuugaguuaguuuuuguauauaguguaagguaggggucuaacuuuauccuuuuguauauggaaauccaguuaucccagaaccauuuguuaaagagacuauucuuucucuguugaauguucuugggucccuuguugaaaaucaauuggccuuucauguauagguuagguucuguacucuaaauuuuauuucauuggucuauaugucuuuccuuaugccauuaccacacugucuuaauugccagugcuuaguaguaaguuuugaaauugggaagugugaguccuccuguuuuguucucuuuuucaagauuauuuuggcuauuuggagccuccuauaauuccauaugaacuugaggauagccuuuuccauuucugcaagaaaaaaaaagaaaaaaaaccccuggaauuuuaauagagauugcauuguggcuguaagauugcuuuggauagcauugcuaucuuaucaauuuuaagucaucuaauucuugaauuguauccuauaaguuugguauguuguguuuuugguauuauuugugucaagguauuuucuuuuuucccuugugauuucuucuuugacccaucggcuauuuaagaguguguugggcugggcacgggggcucaugcuuguaauuccagcacuuugggaggccaaggcggguggaucacgaggucaggaguucaagaccagccuggucaauauggugaaaccaugucucuacuaaaaauacaaaaauuaucuggguaugguggcacacaccuauagucccagcugcucaggaggcugaggcaggagaauugcuggaaccugggagguggagguugcaaugagcugagaucaugccacugcacucgggccugggcaacagagcaagacuccgucucaaaaaaaaaaaaguguguuguuuaauuucuauauauuuguuccuguuuuccuucuguaaaguuucauuccaugaggucagagaagauacuuggaaugcuuucagucuuuuaaaauuuagugagacuuuuuuguggucuaacguauggucuauguuggagaauaucuuuguggaucuucugccuaguugucuuauucauuauugaaaguaggguauuaacugggcacaggggcucacgccuguaaucccaacacuccgggaggccgaggugggcggaucacuugaggccaggaguucaagaccagccuggccaacaaggugaaaccgucucuacuaaaaauacaaaaaaaaaaaaaaaaaaaaaaaaaauuagccaggcgugguggugggcacuuguaaucccagcuacucgggaggcugaggcaggagaaucgcuugaaccugggagguggagguugcagugagcugagacugcaucacugcacuccagccugggcaacaagagugagaaccugucucaaaaaaaaaaaaaaaaaaaaaaaaagaaagaaagaaguaaaggaaguaggguaucgaagacuccagcuguuuuugaacuauuucuccuuuuaauucugucaccuuuugcaggaggcucuguucuuagguguauauauauuucuaaaaguuauaaguuuuucuguccuuucacaguucuuucuucuuuucuuuuguuucuuucuuucuuuuuuuuggagauggagucuagcuccguugccaggcuggagugcaguggugcgaacucggcucacugcaaccuccgccuucuggguucaagugauucuccugccucagccuccugaguagcugggacuauaggcgcgugccaccaugcccagcuaauuuuuguauuuuuaguagagucaggguuucaccauguuggccagguuggucuugaucucuugaccucaugaccugcccaccucagccucccaaagugcugaaauuuaagagauagggucuugcucuguugcccaggcuggagugcaguggugugaucauagcucacuauagccuugaacuccugggcucaagugauccuccugccucagccuccugaguagcugggacuauaggcacacaccacugcaccuugcuaauuuaaaaauuuuuuuuuuuuuggagauggcaucucacacugucugccaggcuggagugcaggggcgcaaucuuggcuuacugcaaacuccaucucccagguucaagcgauucuccugccucagccuccugaguagcugggauuacaagugugcgccacuacaccuggcuaauuuuuuuuuuuuuuuuuuuuugagacggagcuucgcucuuguugcccaggcuggagugcaauggugcgaucuuggcucaccgcaaccucugccucccagguucaaguaauucuccugccucagccucccgaguagcugggauuacaggcaugcaccaccaugcccggcuaauuuuguauuuuuaguagagacaggguuucuccauguugaggcuggucucgaacucuugaccucaggugaucugcccgccucggcuucccaaagugcugggauuacaggcuugagccacgugcccggccuaauuuuuguaguuuuaguagaggcaggguuucgccauguuggucaggccggucucgagcuccugacauugugaucugcccacccuggccucccaaucagcuguuaaucuuaucgaggaccccuuuuacaugaugaaccacuuucuuuuccuuuugaggccuggucuuguuuuguccccaggcugaaguccaguggcgcgaucauggcucauugcagccuugaccucccaggcucagcugauccuccuuccucagccuccugaguagcugggaccacaggcguguacccccacacuuggauaauuuuuaaauuauuuguagacaugaggucuccuuacguuucccaggcuggucucaaacuccuggauucaagugauccuccugccuuggccucccaaaguguugggauuauaggcuugagccauggugcuuauccaagucacuacuuucuugcugcuuucaagauucuuuuugucauuugacaguuugauuacaaaaugucuugguguggaucccuuuauuuuucuugaaguguauugagcuucuuggauguuuagauuugugucauaucaaauuugggaaguuuucugucauuauuucuucaaauauucuuucccuuuccucucuugccucuaugacuccaguuauauguauguugguaugcuugaugguguuccauaggcaucuuagacucuguugauuucccuuccuucuuuuuucuuucuguucuucagacuggauaaauucaacugaccuaucuucaaguuggcugauuguucuaucaguucaaaucugccacugaaauccucuagugaaguuuuuuuuuuguuuguuuuaguuauuguauguuucagcuccaggauaucuauuugauucuuuuuuauaauuucugucucuuuguugguuuucuguuuguugagacauuguucuccugguuucuugucauucuuuuuccuuuuucuuuuccuuuuuuuuuuuuuuuuuuuugagacagggucuugcucuauugcccaggcuggagagcagugguguaaucauggcucacugcagccuugaccuugcagggucaaguaauucucccaccucagccucccaaguagcuugggagaagugccaccaugccuggcuaauuuauuuuuauuccuuuuagaaagggggucuugcuauguuacccaggcuucuuguucuuuguccaucauuuccauuagcucacugaacacauuuaagacaguugauuuaaaaucuuugucuaguaaguccagugucuguucuucuucucagacucuuuguguuaauuucuccuguguauguaccauacuguuuuuauuucuucacaugcuuuguaacauuuuguugaaaacuggagguuuugaauauuauaaugugacuccggaaaucagacccuuccuucugaguuuuuguuguuugcuaugaguuguaguuguuuagugaguguucuaaacucuuucuaaauucuguguucuuuguuguguuuguucucuaaagucucuuucuuagccuguguucagcugaugcuuuguuuguuuguuuuuuguuuuuuugagauggagucuugcucugucacccaggccaggaugcaguggcgcgaucucagcucacugcaaccuccaccucucggguucaagcaauucuccugcgucagccuccugaguagcugggacuaguggugugugccacuaugccuggcuaauuuuuguauuuuuaguagagaugggguuucgccauguuggccaggcuggucuugaacuccugaccucaggugauccacuggccucagccucucaaagugcugggauuauaggcguaagcuaccacgcccgacacuuuguuuuuuguuuuuuagagauggggucucacucugucacucaggcuacagugcaggggcaucauaacucacuguagccuugaacuccuuugcucaagugauccucccaccugagucacugggauuauaggcugagccaccacuaguguuuugacagacuuuuuugaauaccuagagcuucccuccaccaucccccaaaaaagaguagacagaaaggaggacaaccaccuucucccagucuuugcagaauggcuguguugggggacacugugguugcuuagcccugcuguuuacaacucuacuguagccucauuuccugcuugugcugagccgaaaguucagcuaaagggucuuuucagaucuuuucugagcaugcuuccugcccugggcauauaugcaugacuuucuaaauuccuaaccuuaguauaaguggacauuguugaaugcccaaauuuccaaaagaaacuuucucccagcuuuuccucucaggcuguuggugugucuguuugcuucaacugaaaucuuuugccccagguggcugcagauuauuugccuuacaaguuuuuugagcaauacccucugaagagacaccucucugcccuguuccaaguuagggaaagcaaagaccaaugucuugugucaguccuuuagguaacccgcaggcucaaaacaggcaaacgcaauucuuucagaauuucuuccucuggaagcagggacuaaaggaguagguucccagacugagaaugcaggcugcugucuucaagacugccacuggggaagggaaagagagagggcaagucaaaaugcugcaaagcuuuucuacuguuucaaguugcuuuuuuauucaguuugcugaguugcuauaaauguauuuucuggaguugugacaaagcugaucugacaguuuuugcuugauuuuuuagucaucuguggagggaugggccauuggaguuaccugccucaccauuuuuacugaugucccuuaagaaaggcuuuugcuuuguuuuuagagacaaaacaaaaauguuuugugcuauguugcuucgaacuccuggccucaagugauccuccuaccucagccuccuaaauagcugggacuauaagugugugccgcugcgcccagcucccaagaaagauuuuugaaaguuauauuaugauacguugcuuuaaugaguagcguuaaauaaauuauauuaauguuuauaaaaauuaucaacaggauggaauccgacgugguaggcccagagcagauacuguccgcgauuuaauaaaugaaggagagcauucauccagcagaauccguuguaacaucuguaauaggguguuuccacgggagaaaucgcuccaggcucacaaaaggacucauacagguaaguugagcaaauuuuauagagacugccagaaguaacacuuuuuuuuuuuuuuuuuuuuuuuuuuuuuuuuuuugagauagucucgcucuguugcccaggcuggagugcaguggcgcgaucuuggcuuacugcaagcuccgccuccuggguucaagcaauucucuugccucagccuccugaguagcugggauuacaggugugugccaccacgcccagcuaauuuuuguauuuuuaguagagaugggguuucaccauguuggucaggcuggucucgaacuccugaccuugugauccgccugccucggccucccaaagugcugggauuacaggcgugagccaccgcgccuggccagaaguaacacuuaacugaaugcugauuugauauugaguaauaaauuaacuuuuuaguugcuuuauauuuucuuauuaccacuauuaguugugaaguuuuuuaaaaaggcaguauagucaguuucuuuuugguggagaguggugguuuuaugaauacugguuacaugugauuucuaaaguuaucaugguaauuaaccuagaugucauagucauguuauuggcaaauuuaguuuuacccccuacuugcccaaauuguacuugauauacuuuuaucuauguaauuguuaaaauucaucuguaggccaaaaacauuaauugucaaguuuuuaauagaauguuuagaguccucacugugcuaucaggacauuugaccuaagcauuaaaucuguggugaacuaugguaggcagccaucucaagauuaugguacaucuuuauuugcauauggaaauuauauuugcauuuuaaauaucauuuagagagccaaaaaaaaaaaguauagagggcccuuguucucgcuauaaaguuggccccaaaggaaggaaccuuauaguucaucuaauaguuuacaggugaggaaacugaagugccaaaaauccaacuacuaccggcuuacaaucagucucucauaccuuuaaagcuagagcuacacugccccauacaguagccacugugacuccugagcacuugaaauguggguagucuaaauugagaugggcaguaauauaaaacauacuuaauaugaaaaaaagaguaaacaauaauuuuuacuguugauuauguauugaaaugacacuuuuagauaaauuggauuaaauaaaauacauuauuaaaauuaauuucauggcugggugcgguggcugacgccuguaaucccagcacuuugagaggccgagguggguggaucaccugaggucaggaguucaagaccagccuggccaacauggagagaccccaucucuacuaaaaauacaaaauuagccaggugugguggcacauuccuguaaucucaguuacucgggaaacugaggcaggagaaucacuugaacccgggagguggagguugcggugagccaagaugugacauugcacuccagccugggcaacaagaacaaaacucaaucucaaaaaaaaaaaaaaauuuauuucaccucuuucucuuuacuuuuucuaaugugccuucuagaagugguucauauugucuuucauugggcaguacugguuuagaacuuaagccuguaacccucaguccccuauuuuuuuccaccauguuuauggugcucaccuguuucucacuuuuuuuuaacuugugguuuuugaaaauauauauuuaaaugauaugauagaauagagguuuuuuuuaaguuaaaucccuggaaagggguaauguuugaauuuuaaaucauuauaaacuaaggugucuagaaguuuugacuuuggauaccauuaguaaaaugauuacuuaaugaaacauucuaauuuugagaauuuuuauauauuuuuuucaaucuaaauauucuaaaauauccccuggauaacugguuuguaggccguagaguugccaguguggguaagauucaagacuauguggcagaaugaagaaagggcugagugccguccugaucaccacuaccucacugugucaccugauaccccaggcaucagccuagaugucuguacaucaaggaacugaaaggaggaucccuaagggauaguugagcccuauuagcauauuuuguaaaaagcuuuucccuuacuauuuuaaacaaucccccuauaucuguguuuuauuuuaacuuguauucaacuaucacaaccauuuauuaugucucuaaauaaugagaaauuuagggaggacuuguuauucuuugaguuauacuggaaaaugcaaacuaauguacaauuguugauuaaauaauguuuuuuucaauaaauaauguuuaauuaucauuaacaaauuuuucagcacuugagccuggcacuguguugucuauaggaauuuaagugaaguauaagguacuaggaaucuuugcaggagacuaccaugacacauaaacaacacaggaccccagguuaaugaagguauacaaaguucaauuauuuggagguagauaggaagaauucaguuauuuggggagauaggaagaaucucacugagagccuacaggauugggaagauuugaaugggcagagaaaauaggauuuucaaggauuagaacaagaugaggaacugccuccuggcuggaaugauucuccaggagggaaguaaggauaaacucugccccuuaaccccaguagcuaaugagguuggugagauugccuagagugccgaucuuagaggaccauuuaagucagcagauaauuuuuaguuguccaagguguguaauaggauuugggggugguucaggagcuaguugguaugacaaaagcagauuucuaugccagcuacucugggauugcugugcagggggagaaacaagaggccggccaggaggcugucggaggguucauccuagugggagggcugcccgucugaccaggggaagcugagugggaaggcaggaguggguggaagacauagugaagaaucagcaagaucuagugauuuggaguaugagggagaaaaaauaugggauaagcucaagaugauaaccucaaggccuaaagaauagauuguguuccccagcagauagucauugaugccacccaagugcugccauuagcauuuccaccugcagcucaguaggggccaugacauguuuuauuguuauugggagucaugaccuauauaaaggcugauucucuccccaucccccuccucuucuggccuuauuaucucagauauaauaucuaacaucugucuacuuaggugagaggcccuaucugugugacuauccagacuguggaaaagccuuuguucaaaguggacagcucaaaacacaucagcgucuucacaccggagagaaaccuuuuguuuguucagaaaaugguacgguguuagaaguuaaguuuauggaauaacuaguugugacuuaacaguuaaaauauccuuuccuugaauuuuuuugaggggaaagauuuuuuaauauaaauuuuauaaaacuuuauaagcuuucuucuuugauaauugugauacaugcugaauuucucagaaaugauugauuuuaaaaauuuguugguuuugauuuuuguggguacacaguacguauacauauuuacaggguacaugagauacuugauacagacaugcaaugcauaauaaucacaugguaaaugggcuauccauccucucaagcauggguccuuuguguuacaaauaaucccguuauacucuuaacuuauuuuagaauguacaguuaaauuauuauugacuauagucaccgugugcuauaaaauacuaggucuuauucauucuuucuauuuuugguaccuauuaaccauccuuaccugccccucaucccccaguuccccuuccuagccucugggcaccauuguucuacugucuaucuccacgaguucaauuguuuugauauuuagaucccacaaauaagugagaacaagugauguuugucuuucugugccuggcuuaagaaauaauugauuuuuaaauaaaguaauccuuuuugaugaaaccuuaaagggcaauuaaagauacuauauccaguuguaggcaguagaaaaaucuguaaaaguaaauacagccuuuggagcaacauuuuaaacuuuuuaauuauuaaagugaaguaagcauauuauccuaagugauuuucuuaaucuuuuaucaguuucuaaagaugcacauuuuuaugcaguuacaguauauuugaaguuccgugcaaucuguccuguugcucuguaauuuucuugauuauuacaaauguugcaaaagucugcaaaguuuucauccagcaaguuugcuuaagccuauaugcaaugguuuccucuauguugaauaaugaauauuuguuuauuuauuuuuugagacggaguuuugcucuuguugcccaggcuggagugcaauggcgccaucucagcucaccgcaaccuccgccuccuggguucaagcgauucuccugccucagccucccgaguagcugggauuacaggcauacgcgaccauacccaguuaauuuuguauuuuuaguagagaugggguuucuccauguuggucaggcuggucuugaacucccaaucucaggugauucguccaccuuggccucccaaagugcugggauuacaggcgugagccacugcgcccagcauuuauuuauuuauuuauuuuuuauuguuuugagauggagucucacuuuucgcccaggcuggaguacaguggcacgaucuuggcucacugaaaccuucgccuccugaguucaagcaauucuccugccucagccucuggaguagcuggaauuacaggcuugugccaccauguccggcuaauuuuuguauuuuuaguagagaugggggaccauguuggccaggcugguuuugaacugcugaccucaggugauccacccgccucggccucccaaaguguugggauuacaggcaugagccacugcaccuggucugaauauuuaauuuguuuuuuaaauguucuuguuaccaacaaagcugaggggaauguuuucacacguguagcuuuguucaucuuuugggaugcuuccuuauguuggaauccacaaauggaauucucgggucugagguuuugaacuccacccgaccccugcgauggagucuggcucugucgccaggcuggagugcaauggcgugaucucggcucacggcaaccucugccuccuggguucaagcuauucuccugucucagccuccugaguagcugggauuacaggcagagaccaccacacccggcuaauuuucguauuuuuaguagagauggcauuuugccguguuggccagguuggucucuagcuccugaucucaagugauucgccugccucggccucccaaagugcugggauuacaggcgugagccaccacgcccugccauuuugaacauuuugaacucaugcuaauaaaucacuuuccaaugguguuggacacacauggccacgaccaaaaugugacugucuuccuguccccgcucuagcacugaugagacugugcugguuugauuguuuucuccuccaaauuauagauccuaaauuucaccauauuaauuuacuuuucuggauaccagugaaacugaauguuuuccacaugucuaugugcuggauguccagauccugacagguguuaaccuuguguuuugaaggcugccugagcagauucacccaugcaaaccgccacuguccgaagcaccccuacgccaggcugaagagagaggagcccacggacacacucagcaaacaucaggcugccgacaacaaggccgcggccgaguggcuggcgaggucaggaaugcugccuuuaguccaccgugaagaugcacagcgcgggcuggggcuaugucagggaccuggacaugccucucauuuuaaauaagcugcauuuauacacauuuuauaacauaauuagaaaugaccccugauuuucuauaaaauuguugugagugguauuaggaucuuaggaucugugugugauagaaaauuacaauauaauuagagugcccagacuacaguuuauuuuaaaaggaagaguuuuccuauuuugaaaaaauguuuuauauguauuguauuucauucgucaugaaugcaaccuuuuucauuuucuuuauguuagccuuagcuacgugccaauuaaaacagggauagacagccgagguggguggaucgccugaggucaggaguuugagaacagucuggucaacuuagugaaaccccaucuuuacuaaaaauacaaaaauuaccugggcaguaguggcacgugccuauaaucccaguuauucgggagauugaggcagaagaaucgcuugagccugggagacggagguugcagugagccaagauggccccacugcacucuuguacuccagccugggugacagagugagacccugucucaaaacaaagcaaaacaaaacaaaaaaacaccagggauagauguuagugguucuucuuaggugagguuccaaaaacaccaauuuaauuuuuuccaauggcaacaagggggccaguauaaaagaauuucucuaaggauauuucgguugaagggccugucugcuguacacgagccagcagcagcugcucaggccucacccaggcuucacuggcugcuuaggguaaaguccaggauuccuagcugugcugccauagcccugccucccucugauaaggcaacuguccccugccaugcugggcuguggguuucucaacacaggugccuuuguaugagggccugugugcacccugcuuccucugccuggagcacucacuccccacuuggcuaagccucuugcucaccuucaucucuuacucaggaaggccucccugaccugcucagcaacaaacgggcugggaccaacuuaacagaugcuuucauuuuccuuuucaaaacauccaucacacauuuauuuguuuauuuuauaccuucccugccagacugaaagcuuccccgggcagggauauuugucuuguuuauuaugguaagccuagggccuagcagagcuucugggccuugauaaauauuugaaggaauaaacucuguuuuguuuggauaaaaauacauaagaauuauauaauggaaucuggaaauacuauuugauuauucacguccagggaaauuuguuagcacugucauagaaauuguuuagauggacaauucuagggguaccuuaaacuaaauaucuccaucacuuccuccccuccucuuucuccugguuagcuccuacugccccauuauuucuaauugugucccagccagaagcuuacuggucauccuugucuuuuuuuuuuuuuuuuuuuuuuucgagacagggucuuacucuguugucaagacuggacuguaguagcaggauuauuagcucauugagccuugaccuccugggcucaagugauccucccacuucagcccccugaguagcugggaccacaggugugugccaccaugcccagcuaauuuuuaaguuuuuuguagagacugggucuugucacguugcccacgcuggucucaaacuccuggccucaagugauucucgcaccuuggccucccaaacuguugggauuacaggcaugagccaccgcaccucgccuccuugucuuucugcugucuacucagugaccaaguuaugacaucuaccuccuuacuaacucaaauucagccacuugaaugcucucaauccauuuuccaugcugcugccagagggaucuuucuaaaaugucaguaugauccucagucuaaagccuaaacccuuuauuauggaauucaaaguccuuccuuaccugguuccugcugacuugcugaacuuaucuuuugccauucuccucuucuagucauccuucaagucauacugaacaauuugcacuuucuuuuuuuagaccucugugggcauugccaaaacuuuuccacuuuaaguagucuggauuuccugaaauuugguaguuguauuucuuuuuuuuuuugguauguaauuuuaaaaacagcuuuguuggggcugggugcgguggcucacgccuguaaucccaacacuuuggcugagguggguggaucaccugaggucaggaguucaagaucagccuggcuaaauggcaggacccuaucucuacuaaaaauacaggccuggugcggugccucacgccuguaaucccagcacuuugggaggccuaggcaggcagaucaccugaggucgggagaucaagaccagccuggucaacaugguaaaaucccgucauuacacucuagccugggcaagaagagugaaacucugucuccaaaaaaaaaaaaaaaaaaaaaaaaauuagccaggcaugguggugggcgccuauaauuccagcuacucaggaggcugaggcacgagaauaguuugaacccaggaggcgaagguugcagugagccaagauugugccacugcccuccagccugggugacaaagugagacucugucucgaaaaauaaaauaaaaauaaauaaaaacagcuuuguugguauauaaguagcauauaagaaauuaugauacauuuaaaguguacaguuuaauacauuuuaaaguauacaauuugauacauuuuugacauguauauacugugacaccaucuccacaaucaagauggugaacauauccaucauuuccaaguuucuucgugcccccuuugugaacugaacuacacauuccucccugucccccuuccccccauacaacacugaucugcugucacuauaaaauaguaguuuuauacaaauguaguuuguuuauucucucgaugggcauuuggguuauuuuuggcuauuacauauaaagcuacuaugaacauuaauauacaaggcuuuguauggacaguuuuguaugaucuguuacugucauuuaaaaugcauuuuucuuuuuuuuuuuuuucuugaaacggagucucgcucugucacccuggauggagugcagcggcccgacuucagcuugcugcaaccuccgccucccagguucaagucauucuccugccucagccucuggaguagcugggauuacaggugccugccaccaugcccggcaaauuuuuuuguauuuuuaguacagagggguuuucaccauguuagccaggcugguuuugaacucuugaccucaagugaucugccugccuugccucccaaagugcuaggauuacaggcgugagccacugcgcccagccuaaauacucauuucuuuaguuaccaaagaguugagcauuugcauuuucucuuguaaauuaucaguuggccauguaacagaauaaggguaguguuuuuaaguuuuugaauaaacucugugucacagauguuaaucacuuuuucauaguuuguggguuuaauauuuacagcguuaacgcugucagaaguuaccaucccucuguagauaggauaaauaaguuucuaaagacuguuuuuucuacuauuucuguauuuuacucaaguccauuucacacaggcucuuuaaggcggugauaguuuaauggcaaaaacgugauuugagagugaguagaagaucuagaacugccagguuuauuguggaaaccugagcacgucucuuaaccucguugaacuucaguuucuuuccucuauaaauaggaaauuuauguuaaaucacuuuauaacuuuauaaacugaaccacauaaaaguaauauugugguauggaacuuuuuaaaagaaaaguaaacauuuggaaauuucaugucugccauguaacuaauguugcugcauuucacauagguauugggaaaugagagagcagcgcacccccacuuugaaaggcaagcugguucagaaggcugaucaggagcagcaggacccucuggaauaccuucagucugaugaagaggacgacgagaagagaggggcccagcgccggcugcaggagcagcgggagcgccugcauggagcccucgcgcucauagagcuugccaaccugacuggggcgccacuccgacaguagcuuggacacugacucuuccacuguacaaaaguacugcccagcauacuuaaaaaguagauccuugggcauaagcuaagcaccuuauuugcuuaucauaggcugcuauucuguagaaauuuaugaagaauguuauugccccagaauauggggugagagagaacugcacuuuuuuaauauggaaaugaauucaucguaaaguuuaaaauauuuuguaaauauggacugcacaguacaggguagaaaacuacauauugugggaagcuagauuuugcaaguuuaaugcauucauuggaagcaguucucacaggaagcacuuucugaauaagacacuuguuugaaaaacagaaugguacaaauagccaaagaagauuaaaacagauuauuuauaagaucauuuuuaacaauauauauuaguauguuuaacaauacuguaaacacugaagcaagcaagaaaguauaaaauauguaagauagauaauuuuaauugcaaaauacugugcccacuaaggcuagagaaaugggaggcuauuuuggaagauguucuaaguaauggacuuagaagaaaauagauauuugaggcucuugguaagaugcacaauaguucagaauuuuugaaauuggagcaaaaucagucuuauucuaucuggggcuuuacaacucaguauaauguuuaaguuugaaaagcacuugucaucccuagcauguuaacuugggaacuuuugcacauuucauauuucucauuugcugaaauugagugauuaaucuugcaaagucuagguaacauaguaauugguaauuuuaaaaauacauauuaagggcccuguaaugagauuuggcacuuggauuuuuacuaaagggacaccugcaggguuguuuuguagugaaauguuuuagaucuuuuguuagcaaacacuacauuuuaauuguacugcuuguuuagaauuauuagcaaauggaagccuccauauuuauauuuucagugcauaaagccaccuucuugcuuuacuucagaguaacaugccaagcuauuuuguguucacuaaauuuagcuaucaguuaaacacugcagaaaauauuagcuacucaaauaaguaggcuucugaaauaguuuuaacugcaaguguguuaacuuguguggugguuugaagccauuuuuccaaauaaaguuauuaaacaccacuuuauguacugaagcaugaacagaaaaaucaagagcugagcagaccaccuccuuuauguaggcaaaacuuccaucauuuuggcuuuuguucuaaacagaacuaaaugacaugcauagcaugguaacuuacagaucgcuuaauuggaguaaaacucagaguaauagagggaaauaugggcucuucagugccuuuuuagcuuuuuugaguugaagacguuccuacagauguaguuuaaacauuacaaaguaggcuucuuuauccaaaaaucccaaugugucauaguacacagauaguuuaaaauauguagccacggggaaggggaggcauguaaaugucuugaagaggagaaaaaguaugaaagaagauacgauaguuacgaauaauguguaugaugaggacauacuuuaaaaauguaauuccucuguacaguaaauuacaaaucuuuagggauuuuuuuguaauaagagaauuuauauuuguaauggucuaagaauuuuuuuguaaugugguauauagaauuuuaauuuggagcacuuauaagcugguaagagagacuauagcaucugaauuaucuugguuuauguuucagcauuuccucuagaauuuuugcucucaaauaugugauuuaaugaacuaaaaacaacacucaucagucuugggaaauuugaacuuugaucaacuuaacuaaagaaggaaggguaguaagaauuuuucaaauacaaauauuugccaauucacagaugauaacauuuaaggccuucaaaaguaaggguuuuuccuuguuucuccagucagcuuuugucaacucuaauaguuuuuucauaaacauuuuuuauuuguauaauugcaacaguuuaagaaauuaucacaacuauuuagaaacauuuaaaauguucuuuuugauauaagcuauauacuuggaaaaauacauugguaucuaaaauuugagguguguuaagacugcuuuuuguuuuaaaaaaugguuuacauucaaauuuuugaaguguuuuaugcuucauauggcuaaguuguaguuuggcagaguuaacagcauaagaauaaacaugcuguaauuuuaaaagaugcuuugaauaaaaauuuauuuuaauuuaa

SEQ ID NO: 192433 - RNA, 66809 nt, Homo sapiens
ccuuuaaacuuuguuuuuuaaacuucggggguguggucgcggcgccuccccucucggcggcuggcaguccuugccucugccccgccuuccagaugcuuuggagucaugagccgggagggcgcgggggcagcuuugguagccgaggugaucaaaggugagccgggagggcgggggcuuccccugggggcuccggcacccgcgcugggacagggcgggcagugcuggcuuggaggugccccuagucugggccccggccgcccuugucuccugcguguggguggccucggcacuuguccccaggcucugggcuacagcgcucaugggcggcugugacccuugcgugccugcaccugagccuaguaggugagcugcaccuccccgcccgcgggagcgagauccuugggcucugucacagggaucaaagguccuugugguuggaaaggauuaagcccugucacccauuugaguguuugugguugcaagaaguuuuagcugaggaguuuacaaggaaauaaacgcaguaauugcaugaguugaauugcagaucaaaaaaaaaaaaaaaauaguuuaccauuuggggaaagggugccagcuggcucugcugaaaguauauauauuuuaaaggcugugcuugauuuugccacguugugaguguaaguauuuucuuagcaccacuaguauuacuauuagauauuguggaugacuuuauuucacccgaggauuuuuaggcaaggaaugcggguggagccuccugagccuuacuacucauuaccauucuugcuaaccucacagcagccuaacugcauuuaugcaacacaaguucaucucagacccaucaugcagaaaccucauugcuucuguuuuaaugguaauuugucuaauuguaaaaauaccgaaguagugauuccaaguuagaaaguagugaucccuaagaacaguuggagaaacauaugguuuguucuauagcuguaagcgguaauuuugaagcaauuuugaaagcauucuuucccuuuaagaaaaaaauaguuucuuacugaaaugacuuuuuaggaugucuugaaaaacguagugaaauucaucuagaaacuuacaagguugaugcuagccaucacaugcaugcugcaauuugcugaaaugucuugauccaggggagcuaaacuuuuacaaaaauagguuuguuuagaagucauaucacuacaugaaaaaucaccacuuuugaaacuuacgguuaaaggcaguuucucuuuuaaaaaugugcucauugauuauucccacccaaauagccagaauauuuuguaauuacccauuaccacuccuaccaucugaaacgugcaugaaaaaaaugaaaaauugacuucaucugaaaagaguugugucaugauauaugaaacguuuuuuguaaccuccaggaaggaacauugcaauuuuuccauuucagaucgccuuuguuuugccauucucuacagcagaccaaagagugcaucaaauguacauuauuucagcauagauaaugaacuugaauaugagaaguaaguauugcucuuuaaaagauuuuaacuuuuuguuuuugaagaaucuaaagguaugguuauaaaugggauggccugggaaaauuauaaaucuauugauugcuaauuacaggaugcuuguuuuucaccuguaguaauaaaauaaaccuuuagagcaaaaaaaaaaaaaccucccuaaauuuaaacauuuagauuugcuagucuaauauuuacacuacaaugagauauaaauguguacuaaguaagauauugugguuuugcccuuggaaauauguguggaaaaacagcuuuuuuaauuuagaagguauguucauguucauugagguuacauguaggcauuauagcacuuguggcauuuuuaaguaggcauuauuuaccagaauagucuuccaccaguaaaacaguaccuuuaaguuguauuggcccauaacaauuugguauaugcuugcuuaucuuaauuugaucuuguagacccaaaaaaggcauuuauauucagagcaucuagaauguacaucacauuuuuauuuuucauuuuuaaagcuucuacgcagauuuuggaccacucaaucuggcaaugguuuacagauauuguugcaagaucaauaagaaauuaaagguaaagucuuuaagauuugacuuaaguaaucauuguuagcuugaucugggggacgaaaguaaggaaaacaucucuuuuuaaaaaggaaaugacauguuuuucacugcagugguguuugggacaugcacaugguuuucuuguuuuauaagaucauaguguaucuauuuguuuucuagaguuuugaaugaacaguuuaaguuugggucguuugguucuaguuugaauuagugaugcccaaauacuugaaaagccaaagugggaaucaguuaauuaagugaaccucguauugucugaccuaauagaacugaaacuuaacaagagaaacucuucccuugcuguggccauuguucuuucugccuucauuuugauggggagugauagcaaacuaacaagaaagcuggacucaucuuacuuucucuccuauuuugaaacucccaugauacuguacuacaugauccuuuauacauacgauuaaggggcgugagaaucuagggcaaauaagcaugucauuaaggcuguauuacugagaguuacacaaguauauuuguauugguuugaacuuagaccacauucauguauguaaaacacugaauuguuggccaugcacgguaggaaguuauguauguacugcuuacuagcaguuccaaaucagucacuguaaauucucaacuggaaaauacugcuuuuugggacaggcacuuaaaaaaaaaauuuaauugaauacagagaggaaauaaaauuuauuuuuaauuagaauuuuaacaugcuuuaauuaaaaauucauggguaaggcagauguuuuuccuugaccaugaaagcuauauugcuacagagcuggagacucuucuuuuuugccuuucuuaaauaggaauauaacuauuuauggccuugugcauuugaguucccccuccuuuuuccaguugccaguggcagaucuuuuguuucaugcaggacuaggaagcuaaaaauaauucucucuuccuccaacauuuguuccuuugcuuuaauuuuggaaaaaaauuuuuuuccuguacucaaccaucuguggacuuuuagucuuugggucaaccaaaaauguaucaguccuuuuuuucuucuuccuuuuuuuuuuuuuuuuuuuucccgugagacagaguuucgcucuuguugcccaggcuggagugcaguggagcaaucugggcucacuauaaccuccaccccccugguucaagugauucuccugccucagccucccaaguagcugggauuacaggcaugugccaccacgcccagcuaguuuuguauuuuuaguagagacggaguuucuccauguuggucaggcuggucucgaacuccugacuuugugauccauccgccucagccuccuaaaguacugagauuacaggcgugagccaccgcacccaccagaaaacuuuuuaacauauaaauagaaauauguacacaucauggauguagagcucaauaaacuuucacuaauggaauauacauagaugauuaucuugaucaccagucaggagcagugcacuggcggcaccccauagcagcccuccaugcugucuuccaguuccugucucugcacaccccuccccugguuauucacugcccuggcuuauaacacuguagaugauucuguauaccuuuuuauuuuaacuuaaaggcuuuggggacagauuucuuuaaaaaccaaacagaaggaaagguggucuuuucuaccacucuugguuugcucuuucagaagcagcccaugcuuuaagcauguguccauucauguccccuccccucuucucuaauuguauguucauucucaucccagaaugugccuuuuuaugggaagauauaugguauuuguggguaucaauguuaaucuuuucaaaggucuugcuaauaauaugaaugguuaugggauuuggaauugaucuucaucacaaaaugaaauuguggaagacuugaaauuaaaaagaaaaugcuaacaguuauuuauuuuuaugcaguccauuacaauguuaaggaagaaaauuguucauuuuacuggcucugaucagagaaaacaagcaaaugcugccuuccuuguuggaugcuacaugguaaguauuuguuuuccuaauguauucauaaaaaugcacacaacagugguucuuuacauuugcaguuggaauuuugaaaucaagauaaugucuugauuucucuucagaaagaacguguuuugcuuuuaaaaaauugaccaauucaaggaagcugugcuuauguggaaguagcagguagaugagagaucuccuguaccuuccacuuaauuuugcugugaaccuaaaacugcucgggaaaaaagccuauauuuuuuuaaaaagugcccaacuacuuuggcaaagguuuauguuuuauggcacuaaagguuggaaaauagugcuccaaagcuauuucuauucacucgugauccauuuagugaguuguaaaaucaucuuacuggggucaggaccccacuauuaauuuucuaaaaauuuuuuuaaaaagugcuuucuaaaauuugaaucuaggcauuuuuccccuaauuaaggucaucuccuuucucaucaaaacaucuagcaggaggccacgggaugucaguguugucagaagauggguuacauaccacacggauuacauacauaugccaucaagugcuccauuuggaucauuggaaauguacuuuggaauagcaguauuuacauaagaguugugaauuucauuuauuuguaaauaugauggaaaagauuuauuuuuugaagagucacauuuuguuuggcacccaguggauuugucugcaggggcccugaaagcugcaauuuuuccagagccagcuuagagcuccuccagaguacuacccccugugucugguggugagaaagcuggccacgcuguucaguggggaguagccaggggauguuucuuccacccccaccccaccaucaguguaauaguuauucucucugagacuugaaaaaaaggguuguuuuggccgggcgcaguggcuuacgccuguaaucccagcacuuugggaggcugaggcgggcagaucaugaggucaggagaucgagaccauccugguuaacauggugaaacccugucucuacuaaaaaaaaaaaaaauacaaaaaaugagccgggcgugguggcgggcgccuguagucccagcuacuugggaggcugagggaagagaacgucgugaacccgggagguggagcuugcagugagcggagaucgcgccacugcacuccagccugggcgacagagcgagacuccgucucaaaaaagaaaaacaggguuguuuuuggagcucuuuagguucuuucuuccccacuucuagcuugcuccuuaucucuggcaugccuuaccggaccauuuuaaaauuauuuucuggaguauaguuugauaaucuggaauuuacaaagacuaguccaaaaguuggugauauuaguugaaaucguaccucaagauuuaauaauuuucuuuuuuauguauaagguauaucauuaacagcagugguuaaggucuuuguuuuguuuuccuauuuaugcucacaaaaguugaauuaaaugcuucugauugggaggccgaggcaggcagaucacuugaggucagguguacgagaccagccuggccaacauggugaaaccuuguuucuacuaaaaauacaaaaauuaguugggcgugguggcacaugccuguagucccagcuacucgggaggcugaggcaggagaaucccuugaauccaggaguuggaaauugcccugagcugagaucgugccacugcacuccagccugggugacagugagugagacuuugucuccaaaagaaaaaaaaaguuucugagaaaacuucaaaauuuauuaucaucccugaaaguaugaaacauagguuauagauugucuauuaaaauuugguuucauaagcuuucccagacguauugguguuuuccuuucucccagccucucuugguguuucucguacuugcagcaaaagccuuaaaaaaaaaaaaaaaaguuugaguaguuuggcaggcgugguggcaggcgccuguaaucccagcgacuugggagaaugaggcagggaauugcuugaaccuggguggcagagguuacaaugagccgagaucgcaccacagcacuccagccugggcaacagaaugagaccccgucucaaaaaaaaaaaaaaaaagagaaagagaaaagucuauguaugaacccaagaaagaaaaagaguauggagaaguggguguuuuaacugggacauuugguccuauuacuuggccagucacuggggagaggaaccucauagauuaacauaaaucaugacaacuuuauagaaaaaggaauucagccagaauucuugagauucauaaaauauuaaagggaacccuggagaaaugguccuuggugugacagaaaaaaguuccaaccguucuuuguggaucuugccuuuacacugaccuggacaaagucuggauggcugaaguuccaucuaggagagagugcuccugagcagaacuccaaagcagaggggccagaccgggccacuuccgggucaauugcugucucuggucagaugagaugucccugagaugguagggucuugaggagccaggcacgaggacuacagcgugaagaaccucucugaagguggcuaugggcauagugggaacucagucaggguugucuuaaaaacagaaacagaaugugugauaaguuuauaaauaagaaaucacucuuuuuaagucuuguugcugucguuuuuaaacuacuagugaacaaacaacaaccccuugacguauguauugaaaauuuuuuggcauauuuguuuccaguuuuauauuggccuuuugacuuuguuuaugguuguauuuuggaccacagaagcuuauuuuucuauaguuaauauaucuuagauuuagaaauccuuccagaauuucacaccuucagguuaguacugauuugauugguuagggaagugccagguaagcaaauuuggaucuucacucgcauuuauuacuuacccagugaggagcuagcuuggcaggaggauuauagcucuuggcugugacagaagccuuugcagccauagcuggcugcuaaaauaggaauugggagcuguaauguugauaggcaggaaagcaggagaaaagcuucuaagaaaaggaaauguauucauaguagaaaagcagugucaagauauaauauggacaccugaaaagauaacacaucaaagcaagugaagcuuugaucugguuaaaauacguuaaauccucugguuaaagauuuguggagaugagugcuaguucccuauaaacugauccgcauccuugauaacguuuucuggagucgucaggaauuuuggagagaguaagguucuuuaguguucgacuuggcaugguaauguuaaaacaaaaccaaaaaaaucuggaggaagaaucuuuaggaaagaaauauuccaaauagacugacucuguuuauuuuuaucaguccuuuuugaauucagggcuucugaaaguaacguguuuccuucauccuuguauacacagaaagaccuaauguggguugggcagagagugugagguaauccuuuauggcauggaaauaaaguguuauauuuauuuuuuaucuuaaaaacagaagaggugaggcuucaaaaauguguaaaauaugaauugacaugcccacaauuggucuuuuugacagauggucaggcgucauguguguuacaagaagugagaagagugaguugaguacucauuugucuuuauuguauuucaaaguauugcucuucauguggccugguaaauggcuuucccauucagcuaucugaaugguagacucuuugguaucaaauuagagugaagcuaaaaaucuuuugcaccacuguaagaguugaaaaauauaaaagaugacuugagcuuuuguuuguuugcuuauucacaaaaagguaaacauacuauauuguuuuacaaaauaaguuugcugcccuauuuaagccaguggcuaugaccuggccagauugagggauaaugauacuuaaccugucauuucaaaguaaaggugaaauuuuaaguggaaaauuuuaagugcuuuucaaaacaaauucauaauaaaaauccuuuuggaaagaaaaguuggaaauuuuguuuuguuaauuuuguuguaaaaaugucauacacaaaauccauauuugcacucuugagaaauuuaaaaaaucuuuuaaaaagaaguuuuuauauuucuagaaacaagacgugcacguguguguauaugcacagauguauguuguguacguauauguuuuauguuuacaguacaauuuuaaaauuuuuuauugguacauaauuguacauauuuauggguuacaugugauaguuuuauacauguauauaaugugugacagccaaauuagggcaguugcaguauccaucgccucaaacauuugucauuucuuuguguugagagcauuuuaaaucuuccuuucuauuuugaaauacacaguaaguuauuguaaacuauagucacacuacugugcuaucuaacacuagaacuuguucauucuaacuguacauuuguaccaaagaaccaaccucucuucacucccccugaccacacacgcccuucccagccucugauaacccuuauucuacucuuggccuccauaagaucaacuuacuuagcuccugcauaugagugagaacauaaugguauuugucuuucaacuuugguuacaucuuccugccacagcaguuagauuuucugaagauacaugguauucaucucuucuauggguuaaauguacuuuugagggcuagccugggaaauuaaccaccauuucuaacaucuuucuguguauaaaauaaaugccaagcauuuuguguaaaaaauaaaugacacaagcaaacuuuuggcacguagcuugcaaauuugcuuuccucuaauguuuaauagauuacuuugguagagcuaauuguaacauguagguucccuguucaaaauuuaucacuguauauuauuauuuuuuauguuuaagcaguuuuuauagcuguaagaauggcuuaccuuguaagcauuuauguugaaaaugaugauacuaauuaaauuuaagaauauauuaacucagcaaucugugagaagaauucuaaacugcauuaaauuugagauugccucuacaguuaugauaagagcucagggacuuuguuauuuaaugaugaucuuuugaaucuguggucccacuuuuuaaaugauuuaauuaucuuggacucagaauagccagugccugcaggaggaaaggaucaguugggaaguuaagacaagggaacagagaacgaggaucuagacgcaguggguaagaauccaguucagcaaacagcugcccagaugggacagcagaggcuggaggacagaaugaggucauaacacccuuccugggugucugugaaaggcagggcaaacagcacgaggcaaccgucaguaguagccaggccccagcuagugugaggcgaacugggcugagcaaagggacggcacaggcccucagugggaagccagugcuuccuugggagccggcccugugggaggcagcugucugcccugcucacagugcaucacaguuugacuucccuugccacccgagggcuucugacgggcguuuccacugcccguggugcuugcugggugcuguuaacuuggggaaaaagugaagagaaauggcucucugauagcuuaagauccuugacugcagauccguuaagcuuucuggaauuuugggucccauccuuguuccggucauuguuuuagauaggauggguuccugucuauaaauacggccagaggagcaggcccucuuccaucaauaauaggcggugugaucuuggaugagcaguugaugccaaggucuggaaaguuguagccugccaguuuuaugaaacucacagagcauuauaaauaguuguggguuuuuuuuccucugugguuaaaauuuaggagauuucauuuuuuaaaaaaucaagauuuuuuucuuggucuuuaaaaaaugucccuaccacucaaauguguacuaauucccagggccaauucacuauuuuuauuagcagacuugguagauacguguuugcuacucugaacuuccaguuucauuuugucgaaauugaggaucauuauauauaucauuauauauauguaaaaguaauuuuaaaaguuaaaacuauugaaauauaaguucaucugagguuuuuuuuaacgaguuuuuuuucuuaaccaguuuugugcaggagcuaugaaagugauuuuauuuacuuuuuuauucucuguguucuuuccucugcucaccuuuuuuauugagcaguugaauguguaagccuaucuucaacuugcauugauuugugagcauucuuuguuaaucuggagagagugauuuuuuuuuuuaauaaucaaucaaguucuuggcguaggaaagacuguaucaucuggcugacaugaaaauagucacaagagucuuuaagugcuggaaacauugugacaucucuccaggauuuccugguuacucaggcugccacauuuguugcuggaauuucaauauccuuugucacucucagcucuagggugaaaugacuuguguaacguuuggguucuaaauuguacagaggcucucuaaguauauaaauaaagcuucagaauccugugcauaagaguagaaauaggaagcacaugucuaauuggguuuccaugauuugaggcccggcuugucagcauugaaacauugaaaggagaaguaaugcagcugggauccuguugcuucuguugcuuguucuuccaucacugcuaguucaauaccuccgagguuuugaaacguauguuaguaaucgaggguccagcguucucacagggacucuggcaugcagauggugauuuuagaaaguggggguggugggaaguccugggaaugguugagguauuguucagcaaaaaaagaacuuugugccaugacuuugaaaaccacaccagucucaagcauuuucaaccacaguauuugcguguguuugugugauauuugcucguucagagagagucuuuauccuagagaaacaaggucuuacugaugccuccuaagcugcaucucugugcuuacgccucauguauuugucuauucacuuuuaacaaauggaaacggccauuuccuuaaauugagugugcuacugcacacuauugcugcccagcaaauuacugcaaaacuuugugaccuaaaacaacaguacgaauugucuuagaccaugucuaugaguuaggcaucugggaguugcuuaacuugguugggucuggucugguucuguaccgugucugggcugcauucaccuggaggguccaugucuaagggggcucagucacauaccuggcagguuagugccgauugcuggcaggaggccucucuuccauaccacgugggcugcuugaguauccucccaaaauaacagcuugcuguacccagagcgaggguucuaagagaaagcaugacaggagcuaccucuuuuaugaucuagccucugaaaucacacccuauuacuccaguauccuguucguuacacaggggcacccuguucaccgugggaggggaccacacaaggguggaaaugccagcagaugagacucuuugggguugccugggaagcuggcgaucacagcuggucagcagcucucuuggucaucauuuguuguuuccuguucuuaacuagcacuguggaauuagagugggcauucuauauauauagcuucucaugaaaauauaucaaaagaauuugagaaacgccaaguguccagacugccagaagcacggugauagaucauaaguugcaucaauuuagaguuuacuaaucugagaauuuguguuaauguaggaguuauuuauaggauucuucuuuaguaacaaauuuagaaugauuucauuugggaaggccuuuugaaucagcaagaugaguagguguaaaaguaaaaguuacuuccuucaugccuggccaaaaaagaaaaaaagguaaaaguuauagauuggcaaauauaucuuugauaguuauauaaguggauuuguucugcaucuguaaacuuccuucaguuuaucuaguuaugcuuuacauuauuuauuuaugugccagcauuccccaacuggauuuuuaaauuacagucuuuuaaaguucaucgucaggaauuuagggguuuuuucccccauaggaaaaaaauguuacauuguucuugugguuuuuugaaucaaacuaguguuccaaggcuaaaccacaguccuuaauguauuacagacuauuuuugcuuugaaaguuaggagaaaguaauaccauugcaauuuuacuaauuaaagaacccaaagaacuguaaucacaagcaggaaaaauuaucuuaaauuagugcuuaaggaaaaauuuguauaauuugagagaaggccuuagaaauuuagagaaauuccuaaaugggucucuagauuucauuuuaguacacagaugaaucagacucuauucuuauuuuuauuggcuucaagguguuuuuuuauuugguuuuguuuuuugguuuuaggguuuuguuuuguuuuuuuguuuuugccuuuugagacugacucuuggucugucgcccaugcuggagugcaguggcgcgaucucggcucacugcaaccuccgccuccuggguucaagggauucuccugccuuagccuccugaguggcugggguuacaggagccugccaccaugcaggguaauuuuuuguauuuuuaguagagacgggguuucaccguguuagccaggauggucuccaucuccugaccucgugaucugccugugauggccucccaaaguccugggauuacaggcgugagccaccgcacccuuccgguuuuagguuuuguuuuuuguuuuuuuuuaaucugcuaggaagucuuaaaauagaauggagaaaaugaaagacuuuacugauguuaucugguaaguguuagaagaggcauacaugcaucggagacuggaagggaauaagggaauuuggaaaaaacaggcugauuuuuuuaaauguuuuaauuuucaugacuuauagguugaugcuuagaagaucuguguguaggccggacaugguggcucaugucuguaaucccagcacuuugggaggccgaggcaggcggaucaccugaagucaggaguuugagaccagccuggcaaacauggugaaaccccaucucuacuaaaaauacaaaaaaacuagccaggcgugguggugcacgccuauaguuccagcuacucgggagguugaggcaggagaauugcuugaaccugggagguggagguuacagugagcugagaucacaccauugcacuccagccuaggcgacaagagugaaacuccaucucaaaaaaaaaaaaaaagaaaagaaaagaaagaaacagaaacaggccagucauugggaaaauuuuccguuuaugagucuugagucagaaaauuggugaaaugcccuuuggaagcugagucagugcuuaugacuaguuuuaggauaugucuguuucugaguuucuaagauccuugcuggaucuuugaacuuugaaaaauuucucuuaguccagugauaguuucacauugauaucaacuuuuauuaaacauuuaaaauuuuccuaacuauuguaaguagauuuggguucagcuaaguacaucagugaaucggauugguguguaaugaaaccauaagacaugggucccaacuucagaaugcuucacauuugguuguggaaacaggucacauguaucauguuaaguaauggagauaaaaaguuugcaauuaacuuuuuuuagugauuucuuuuuuuuuauuagugaaauuuaaaaucuauuuccccaaaguaaucuuuggaguucaaccuaauuuuagugauaauauaugugccagauuuaaugcuguuucuccuucccaccgcucccgccuccccaaccccaaccuuccguacauuaguugaaagggcccugcaggaagguucugaagucccaggcaaauguaauaggggguaggcagaggacuuacuuagagagaugguggugaaagucucaaacugcagauuucuagaacaaacagguuacuuguaagaagcagacagagauacuuagaucaguaaaauacuucuguaacacuagaagugagaagacaugagaacguuaucuagaaacuaucaagaggaaaugacugcagaccaaaaauccuacgcauaguagucaaauaaaaaaugucaagggaaaaaaaaaauguuuggaaaggcaaggaauaccaacuauagaccucaaaugcugaagaauauacuugagguauucucccagguuaaagucaaagcauagcauaguucuaaggacaaaagaagucaaugagcgucgaaaacaagugcaguuugauaaucaacuuguucaguauugcaagcccucacaccuacauggacagaguuaaucacagucuguguucugccuuugugucucuuuccaccucaccccagucuaaccccauccccaucuccuacacgcugcuuagcugucauuucaguggacuuucaggaaggaggggagguaaaagcaugggaucagucuaacgucuugauuuggaaaaucuguuuuuaaaauacugugcuucuuaccacaaaagguugcugugaagaguuguuggucagggcuuauacugcaaacaacagaaaccagcaauggaggauuuaaacaaaaaagaaaucuauggacaggauucugggugauuccuaggcuccuggggaaggcuggagaacccugcucaguugguuggaaauuggacaaaauuuacuucgcagugacagcacuguaucuucacuuagaaauaaauugccuuuuucuucuuuuuucaaacauagguuauauauuuggggagaaccccagaagaagcauauagaauauuaaucuuuggagagacauccuauauuccuuucagguaaauauaagaaugaugugguagauucagguaaucagauccuugccagaaauaucuugauaguuguuucugaaaaaagaagaucugguaaauagucauuuuaggaugagcgcaaauaacaccacagaucuggguuuuuccacagugacacuguugacguuuugucauggaggcuaucuugugcgucguagcauguuuaguggccuccguggcuucugcccacuagaugcugguaaaauccccacacccacucuaauugucaaaacucagaaugucuucagacauugccauauaucccuguaagugaccuugggggauggagagcaaaaucucccuacgcugagaacuacugccauugaugaaaacuaagcuuuggcugggcacaguggcucaugccuguaaucccagcauauuggaaugccaagguggaaugauugcgugagcccaggaguuccagaccagccucggcaacaaagacagaccccaucucuauaaaaaaauuuuaaaaaaaauuagccaggcgugguugcacaugccuguagucccagcuacuugggagacugaggcuggaggauuguuugagccuaggaguucgagggugcagugagugagcuauggucauaccacagcacucaagccugggcaauagagagauaacuugucucaaaaaaaaaaaaaaaaaaagcaaaccccaaaaccuaggcuuuguaucaggugagaauccuggguuauuguacucaaaacuaccacugaggagugugguuccugagaaguuaagaaacguucccaauaaucaguaguuacuuucugggaccaaaaugaaccccuuuuuucuggggacacagucaguagagacagucgauaagguugcuaaugcaguaccacuuccagaaaaaccagucaagucacuguguuccagaggugguaguuagugaugucuacaggaauggaugacaucaucucaaacuuagcaugcgauuguguugaagauauuucuagaagacuagugcuuaaaucaaguucuaaaaauuuuucugcucguuuaucaaaauacuugacuuagcucuauaguuuaaauacuuguaugguacuuaauggguaauaaauguaugaaauaauuuuacucauugaagacuuugauauuuucaaaaacugcuuguucuuccauucacaaauuaauaauaacuauugcuuauuaguucauuguucaaacuaauuaguucguuaguuuaucguauuaggauuguuacauaaaccacaaaugccugauuuugaauguauggcccuaacuuuaaaaaagggaguuugugaaucugacuuuauuguagaugagccuugggauggguauuucuaauuauuggcagaaucucccuuucaaauaacuuuauaggccugccuguggacuuacuccaugaaauaacaauuugucagggcagucugaagacuucaguaauacgcugcaugaaaaauugugaaaaucugugauugagcaaauuagaauuggcuugaacccaguaucaucccuuucugcuagcucauggcucaucuuaaguauucuuuuauuugagguggguaggaagggaagagggggaaauaaagaucauuuucuaagcuggaaaauucuucucaaccuauaacauaauagcaaccacauucuuccuuuaaaagaaaugcuuguauuuuuggucuugagucacaggcaccuuggucaucucuugauguagugacauuuguucuauagaacucuucuuuauaaugguaaucuuuugugaugccacucuuagauuuacagcacaagguccugaaauaggaacaugcucacacauuucgcacugugcaaugaaggauccauggaacacuguugaugugaaaaaagacguuuugaguuaauuuaaauacaggugccaaaaacagaauaagcauugcuuacugccuugcuauguuucaaauuauuaaaguuuggcacugagaaaugaaguuaguuccuuuuggucccaggagcaucagucaguaauucuccaaaaggcaagacuuagcuagaaaccauucagcuuuguggaauuugaaucucuucuauuguagauacuagguauuugauuuaucuaaacaguguuucuuucuuuuuuuuuuuuuagacggagucuugcucugucgcuaagcuggagugcaguggugcaaucuggacucacugcaaccucugccucccaaguucaagcgauucuucugccucagccucccgaguagcuaggacuacaggcgugugccaccacgccuggcuaauuuuuguauuuuuaguagagaaugggguuucaccauguuggccaggaugucuugaucucuugaccucaugauccgcccgccucagccucccaaagugcugggauuucauaaaguguggccugugaacuggugccgaucugugacauuuuguuaccagccuguguugagauaaauacagaaguugagaauaagauuuuagaaacauuuauaguuaucgaauagagcaauuuuaugucuguagaaucaaauaguagaagaaauuugagcuuguauuuuguuuuuuuuccccuuucauuuuucuaguaauuuauuuuauucacaaaaauaagauuauugcauuacuggauauguaauaguauaguacuauugcauuucauauuuaucuuacaaaagugucaaccugugauagacuuaguuuuuaaauuuagugcuucuucacauaguguucuauagaacuuaucaauuagaaaguaguccaaucagaauuaauaaagccugauaauauuuugauagaaaugacauuauauucuuuguaucuugccacuuuaaguacauagaauaaauaugaccaacaaaguauugcuaacacgacguugugcaagaauggcauucauuuauagcaaauaaguucuuuuauguucuguagcaauguuuuauuuaauuagauuuaauucaacuuagauagaauucucucucucucuuuuuuuuuuuuuuaaagacagauucuugcucugucacccaggcuggaguucaguggcgcaaucuuggcucacugcaaccucugccucccagguucagggaauucucaugucucagccucuagagcagaugccaccaugcccggcuaauuuuuguauuuuuaguagagaugggguuucacuaaguugcccaggcuggucucaacccccuggccugaagugauccgccuaccuuggccucccaaagugcugggauuacaggggugagccacugugcccagccuucuuuaaccacugaguuuuaaaguguguguguauguauguguguguguauguguguauaugauuucuuauugaguuauauuaaauauuucucugugucuggucugcauaauuaaauaguauaaaauauaguuuaauuuuuuuuaaauaucauaggaucauuguuaugaacaguguguauuucuguucucugguauuaucuguuauaauacucuuugcuucuuaguuguuuuuguguguguggggcuugccucugcuuccuguuuucuugagagguaguauuguauauuuguuaauagcuugacuugacaucagacagaugggagucuugcugucagcucugcuacugacaucucugugguccuuuacagauuugagccuuggucuccuagucuuuaaacagaaacaauaggcugggcgcuguggcucacgccuguaauccuagcacuuugggaggcugaggugggcagaucacaaggucaggagaucgagaccauccuggcuaacacggugaaaccccgucucuacuaaaaauacaaaaaauuagccaggcgugguggcgggcgccuauagucccagcuacucaggaggcugaggcaggagaaugcugugaacccgggaggcagagcuugcauugagcugagauggugccacugcacuccagccugggcaacagagcgaggcuccaucucaaaaaaaaaacagaaacagaaacaauaauacauucucucucaaggaguugugaggaugaagugacauccugcauauaaaacacuugguauaggcugggcaugguggcucaugccuauaauuccagcacuucggaaggcugaggcaggaggauagcuugaggccaggauuuggaagaucagccuugcagcauagcaagaccauuucucuuuggggaaaaaaaaauuagcugggcaggguggcaugugucuguaguccuagcuacuugggagacuaaggcaggaggaucccucaagccuaggaggcuucagugagcuuucauuaugccacugcacucagccugcacaacagaacaagaccguaucuuuuuuuuuuuuuuuaagacagacucucgcucugucacccaggcuggagugcauuggugugaucucggcucacugcagccuccaccuccuggguucaagcgauucuccugccucagccuccugaguagcugggauuacaggugcccgccaccacaccuggcuaauuuuuuguauuuuuaguagagaugggguuuugccauguuggccaggcuggucuugaacucccgaccucaggugauccaccagccucggcuucccagagugcuggaauuacaggcaugagccacugugccuggccaagacccugucucuuaaaaaaaaaacaaacacuugauauaguaccuggccuuuaacuaauauuuguuaaauauuccaaccuucccccuuuuaaguugacugucauuuagcuacuuuuuuuugagucggagucuugcucugucgcccaggcuggagugcaguggcacgaucuuggcucacggcaagcuccgccuccuggguucacgccauucuccugccucagccucccaaguagcugggacuacaggcgccugccaccacgcccagcuaauuuuuuguauuuuuaguagagacgggguuucacuguguuagccaggauggucucaaucuccugaccucaugauccucccgccucagguucccaaagugcugggauuacaggcaugagccaccgagcccggccauuuaccuacauguuuaaaaaucacugucguggccgggcgcgguggcucacgccuguaauccugccacuuugggaggcugaggcaaguggaucaccugaggucaggaguucaagaugagccuggccaacgugguaaaacccugucucuacuaaaaauacaaaaauuagcagggcaugguggugcacaccuguaaucccagcuacuugggaggcugaggcacgagaaucacuucaaccugagaggcggagauugcagugagcugagaucgugucauugcacuccagccugggcgacaagagcgaaacuccguccccaccccacuccccgcaaaaaaaaaaaaaaauucucugucuccuagauuucccucccaccccuuuccagucagucaucacccccagcuaaucauugcucugacuucuaccacuaucaguuuugcuugccuuugaacuugauauuacugguaugcauuuuggggagcugucaacuggauuucacauauguaaugucuaugagauuuaccuguguuguggaagguaucaguaguucauccuuuuuuauuccuuuuguagcauuccagucuaugaguauaccacaauuuauuugccugugguccuuuugauggauauuugggucauucguaguuuuuggccguggugaauacgagcuguuacgaaagcugccauucuuuaaaacuaguauuugacauuguugugcaguuucuaagcagugcccauuuauugauucuuacguguuuuccaaauuuguuaaaugaucuuggugacaaggaucccuccccacugcccaaggcuuauaaacugagccucagaguugcuguucugccuauuggaagaaggcugaaugcaaggugggaggaagaugugaugugggugugucuaaaauuggaggugcuaaugaaauacacuugagugagcaaagauucuugucguauauucagauucuaugauguaugaggcaggacuucagcagggcccagaugaaagcgugugaaaucaucacagauuggagcggggcugugccccacaguagguucucaaaaaaaaaaaaaaagcauugaagaaauuugccaaaaugucacagagacugaaucaacaugucuuuaacuugauuggaaaagauuaucaguagguuaagaagauaaucaagccaggcgcaguggcucacgccuauaaucccagcacuuuggaaggccaagguagguggaucacgaggucaggagauugagaccauccuggcuaacacagugaaacuccaucucuacugaaaauacaaaaaaauuagcugggcgugguggcaggcgccuguagucccaguuauuugggaggcugaggcaggagaauguugugaacccaggagguggagcuuacagugagccaagaucgcgccacugcacucacuccagggggagacugucaaaaaaaaaaaaaaaaaagaaaauaaucauacuccuucacagagaagacaugguuaaaaucauugggauccaacuugaggguuuaccccauuuccauugauaauuuugauuugauuuaggcuaaaguacuucauuuuccugccuuaguuucucuaccuaaauggguucuuuauuccaugaacacccuauuucuacaaaaccaggauuuguguugauuuguagguuggugauucauaaacuugaacacaaucacagacaacuagaggaccuguuaagacacaaauuaccuggcccuaucccgagaacuuugauucaguagaugugggguagcccugagaauuugcauuucuaacagguggggugguccuggugcugcuggccuggggaccacugcuggaaguccuuuuguuuuuuucuuucugaauauugccaauaaaguguugguaaaaucguggccuuuuagguuaaagacuuuuucuaggauguggaagagaaguuuuucacuucagaaccuuacagaacaaaaaugguguguucuaagaccuuguguuggcugaacgcaguggcucacaccuguaaucccagcacuuugggaggcugaggcaggcagagugcuugagcucaggaguucgagaccagccugggcaacauggugaaaccccaacucuaccaaaaaauacgaaaacuuagccaggccugguggugugcaccuuuggucccagcuacuccagaggcugaggugggaggaucgcuuuagcccaggaggucaaggcugcagugagccaugauugcaccacugcacuccagccugggcaacauagugagaccgugucucaaaaaaagaaaacaagacccugcauucuguccucaugaagguucgcauagcucaguaauucuaagcagcucagucaguaacauugaagacgauuuuagcuaaaaaggaugccuuuucuugcccucauugcuguaguuuuggcccuuaagguuugagcaagaauuaaaaguuuaaaaugugguuuaguuuuuauucuaacauuuguggaauauucauuuuccccuuuuaaguuaauguauaacuuauaguuuuuaacaaaaacacuaaucuuuuuuuauuuuauuuuauuuuuuugagaugggagucucgcucugucaccaggcuggagugcaguggcgugcgaucuuggcucauugcaaccucugccucccagguucaagugauucuccuuccucagccucccggguagcugggacuacaggugcgcgccaccaugcccggcuaauuuuuauguuuuuaguagagacaggguuucaccauguuggccaggauggucucaaucucuugaccucgugauccaccugccucggccucccaaagugcugggauuacaggcgugagccaccacgcccggccucaaaaacacuaaucuuaaguguacaguaguaagguuuuacauguauuuauguaacuaccacacaguaagaaauauuacagugugaagacccaaauaagguggggaauuagugauagcuccaccagcaacccuguuuccccaggagcaaaugaguaccauucagauaggcacaguuuuucugcaugccuagcuuaaucauaauuaaauuaauuuuuauguugccuaauuccagaagauuucaucuuguaauggcucaagguagccaaaaaggagaagcaggguaggggucggggugccuuauuucucuggguaaaaccuuacuugauauuaagagauuuguauaggaagauuuacugguauguauugaugcaguguuuggcuggaguugucuguaaaguaauauaagcacuuucccaaaacuagagugauccuguggaagguaguugacuuguuaguuccugugguuuuauugguauuacuguccuuuaaaaaucagaaagaagguagggcacagcuguuuacaccuguaaucucaacacuucgggaggccaaaaaggugagaagacugcuugaggcuagaaguuuuuuuuuuuuuugagacgagucucgagucucgcucugucacccaggcuggagugcaauggcgcaagcuccgcucacugcaagcuccgccuccggguucacgccauucuccugccucagccucggaguagcugggacuacaggugccccccaccacgcccggcucauuuuucguauuuuuaguagagacaggguuucaccguguuagccaggaagaucucgaucuccucaccuugugauccacuugccucggccucgcaaaguggugggauuacaggcguuagccacugugcccagccaguuguguggguguuuugggcuuguuguuuuuuguuuuuuguuuuuugagauagagucucacuuugucgcccaggcuggagugcaguggcaugaucucggcucacugcaaccuccaucucucuuguucaagcaauucucugccuuagccuccugaguagcugggauuacaggcgcccaccaccgugccuggcuaauuuuuguauuuuuaguagagacaggguuucaucaucuuagccaggcuggucuugaacuccugaccucgugauccaccugccucggccucccuaagugcugggauuacaugccugagccacugcgcccggcagaggccgggaguuuaagaccagccuugguaucauaaugagacuccaucucuaccuuaaaaaaaaaaaaaaaaguuagcuagaugcggugauacaugccugugguccuugcuacuggggacacugaggugggaggaucacuuaaacccaggaguuugaggcugcagugagcugcacugcaccccaacaugggcaacagggcaagacguuaucucuauaaaaaaguuuaaaaaaaaaacccagaaguuacccaguuaaauggguaaaagucuuuaggauaacgauagcaacaaaaugcuuaugaccuucuaccuaauauuuuaaaugugaccuugauuucucaguauuucugucauacuugguuggagacacacacacacagacagacacacguauaaauagacacacauacacacauauguuuauuacaggaucaaaaagcagucuuucccaguaagauuuucauacgguauuuuccaguuuaaagaaaaaauucaaaugcuuugccccuuugggggagagauagguauugauuuguugaauucaagaagguggcucagcuguuaaagccaaaaauaauccagagagaacauuugaaauuuaggaaguggucauuauugauccaggcccauaaaacaguaccuauuggaauagguagaaacugcagugaaauuuguaauugauuuaucuuuuauuuaaaagucaaaaggcgagauuuuuuucuucuugauaaugguucagaguguacauuugauuuuaaauucuagucaccuuugucuuagguaaguguaauugcagaaaauuaacugaucuacauuuuauuacucuuggguuucagagaugcugccuauggaaguugcaauuucuacauuacacuucuugacuguuuucaugcaguaaagaaggugagugacauguaggaugcacccaguguuguguugaggaacuaacaugcgguccaagaaaacuaggccuucuucccgagaucuuuuuguuaguguuucuuccaagaugccuauggugacagaggugcuccauuucccaacuaaugucagaaugagaccaaaccaggaaacaguuuauucugaauuucugagugcuucuauguaugaguugggggaaaagucacuuaagaaacagggaaaauaagaguuauacgauuagguucuagauccagaauugguuuugaguauauuaugaucuaaaagaacaaaaguaaagaugacuuguuuacugguaaguucucuuugauuuguauauucuauauaccugauuccugccaauaccauuacaacagacguaacacagucacugucaaacacuucauuuuuguuuugucaggcguucaauuucuaguucaacagaauuugaaugccucaauuaguuuguuauacaguuuuaugugaaacuaagugggucacugcugcuuugucaaacuauuuccaagugauuccuugggucauaaccagggcugcuguguugauuccaggggacacccucccuaucacguucuacgugaacaggguccccuggggucacacagugcagcaaguccugguauuaaugucaggacagcaggagaaacuagaaugguaaaucaguagcccauggaucaaauaagccuuugacagcauuuuucuguaacuugugcuuuuagagccaaaaggaacccagguuuacuuucuuguauaaugaaacaugguggcuugcugggaauugugacagacaugucuuaaaacgagaggacuaaucagcauacaaauucagagacuaauugauauacuuuuuucccuguaucaaucaaugagguaugggcacauuguuuggauuugagcccagugacugugggauauggagcugauugggguaguugccaugagcucugaggcggcuccaugggcccucagugugggcagguauggggcacugguggaaaucaggagaccaaagggcaacagguguaaaugguaccuucugguugcaguugcagccccugccaggugggcucaugcaggcaggcacacucaccuuuaaaaagagaaaaguaaagcuuugagggguuuggaaaugaucuauuauaacaccauauggcagcuucuauuauuauuuuuuggcuuuuuuuuuuuuaauuggguauugcacccaaagucaauuagcugguacgauaggucaaagauugccauuugcauacuauauuuuggguuuuuuuaaaauuaaauuuucauuuuuucugcuaugcucagcuaauuuuuauauuuuuuguggagaugaggucucacuauguugccuaggcuggucucaaacuccugagcucaagcgauccacucaccuuggccucccaaagugcugggauuacaggcgugcaccaccgcacccagccacuauauuuaguuuuauuuaagggucacuaucuucugauuugcaguguaagcauuuuuuauuugugacugauuuugaauauugcauauaugaagaaacaugcaucaauguaauuauguuuucagugugauucacuuccaauaagaucaccucaugaaauucaaaggaaaauaggaauuccuuauaaacuacuuuuuuuuauuguuucauucuauuagaaauagcuguaguccaaaaucaugaaauauauugcagucaaggaaauaaauuuugugauugacuuagucuugggauuaguguuuaaauaacuauauaaaaugaagaccuuuuuaguugauauucuagccuucuuauuuuacauuuguauuucaguaguuuacuuuugaaaacuggguguacaaaagcccccucuuugaaccaagaauaccuuguggaucagcaauucuugcuucccuccuguuuggcucagggaucagcagccaggaggauauuucucagaggcugcuaggucuguuuguccuugucucagaaaauagacacucugcuuauuuugguuaucauacucugccugcuaucacacagaguaaggcuauaggauaggacagaaauuuuuuuuguuuuauuccuauggaaagaauaucuuuuuuuuccucaaaaguuuugauuuuaguguugaugucagagcuguuuacuuuagggaacauugauuaaagacuguucggaagaauuugaaaaugaagauauggaugaaguaugaggguuuuguuugggauaaacuagcacauggauucucuccucuuucuuaucgauguagagaccauuggguugugcauuauauuugaauccuaaacuucugaauuuucagccaggggugguagugaucugguaagagaagaggauuacuuucagggcgugauuauuuaacaauacauggauaggaugacuggugaaugaaaauaaaaaagcacaucucacaaacaaaauccaaacaaaacacaacaaacuuauuacauauaguuauaauuaauuuccauauaaaagaagcacuuagaagacgccgcccacuuccuuugaaagcuguucaguggaaaguaaucugaucaugacaauacuuucuuggggggccccugauauuuaguauucugaaauuggauaggaaacuguuuucuuauuugcauccuuguucuuaaaagcuuucuuuuggauuuuaggcaaugcaguauggcuuccuuaauuucaacucauuuaaccuugaugaauaugaacacuaugaaguaagucuucaaggaucauguuuucaacucuuccuccccccgcccagcuuuauugaggggaauaauugacaaauaaaacuuauauauacuuaagauguacaaaguaauguuuugauauauguauacaccaugaaaugauuaccuaaucaagcuaauuaacauauucaucaccucacauaauuuagucuuuuggcgugugugaugagaauaccugagauguacucuagcagauuucaagcauacaguacacacauuagaucuccagaauuuacuuauccucugaugguuuguacucugaccaaaauuucucugccuguuuuuaauuuuucuuuuuuuaaauugaaaaaaaaagagagagaccaagucucgcucuguuaccuaggcugaagugcagugguauacauggcucacugcagccuugaacuucugggauuaaaugauccucucucuucagccucccaaguagcuggaaucacagguauguaccaccaugccaggcuaauuuuuuaauuuuuauuuuuguagagaugggguuucacuuuguugcccaggcuagaguugaacuccuggccucaagcacuucucccaccuuggccucccaaagugcuaggaucacagaugugugccacugugcacggcccuguuuuuagcuuucuuaaucacccauuucacuuacagaagcaauauucuuguuuuguuuuagacguguauagagugaaaaaaagucaagucuucaucuucuuaucccuauuucuccugucccaauucucagugggaauuucugcauuugaugcacaauucuagagugaaugagugugccccguguguucuuuauacuguuuaguuuaaauguauuuuaguauugauggcugucacacagugauugagaugcuuuuaaaacccuuagcauagaauaagaugagaugaauagucauuauacaccuaauuaucucuggaaaauaucuuuguuuuugccauaaccuucgguuugucaggacacuucugguugcaaguuacagaaaguaaacacaaauagcuuaaauaaaaaaggaaaaaucugccaggcgcaguggcucaugccuguaauccuagcacuuugggaggccuagaggggcagauugccugagcucaggaguuugagaucagccugggcaacauggugaaaccucaucucuaaaauacaaaaaguuagccaggcgugguggugggcgccuguagucccagcuacucaggaggcugaggcaggagaaucacuugaacccgggaggcagagguugccgugagccaagaucaccccacugcacuccagccugggugacagagcaagauucugucucaaaaaaaagggaaaaauuuacuggauuacauaaauuaaaaguccaggaauaggauuggcuucuagcaugccccuucaggugcucagacacuuaaucagaaauuggacuugaaguuaguuuuauucucaggccagccuucuccaguagugauaaagauggccaccagcaacuuugaccugccaguuuggcaaaaugaucagaaaaguguaaucuuagcuccaucagaaggcccaggaaugccucucacuggccugacuuacgucaugugcccaucucugcaccagccuguguucuuuggcagggcagggcuaaggaauacucuggccagccuuaguucucuggccaucccaggagccuggggcauagggucagccccaucaaaccagccggaccaaaaaaaaauuuauuuucuaacaguuuuauuuuauuuuauuuuucuuucuuucuuuuuuagagacagggucucacucugcugcccaggcuggagugcaguggugcgaucuuggcucacugcauucucucucccagguucaagugauccucccaccucagccucccaguaacggggacuacaggcacgugccaccaugcccagcuaauuuuguaauuuuuuuguagagaugggauuucgccauguuucccagccuggucacaaacuccugcacucaagggaucuaccugccucagucucccaaagugcugggauuacagauguaagccacggcacccaaccacacaaaauuucuuaaaaacauaggacagggccagggagagauaagccaggcaaaaccacagguguguucuauguuuuuuaacauaguauauauauuuuaaaaagaauaaauaauuugauucuacagcuuuauccuccaaauagggaaugaguaagauacugugcuaaagcccuuuucagcccagaguaguuguagccuccugucuucuuacccugcuguaguuaccuugagcagacuugcuccccagcacuggggagaugauuccucaaacagcagcacuucauguggcagcaucuugaauccucagagaauucuuuuucacaacguccaaaguaaauauuauuucaaacucuuacguuuaacugaacuguuuuuucaauuucaguuaauaaugacacucaguuguuucugugauguaccaaagauguaagaauacauuguaggauucauuagggccaacccugucuuuacuucucugauagcaguccauuucuaaaguacaacguacauuuaacuagcaccuuaaacuuacagaauauagcuaaguuauuaacaccuuuuuugcgcuuguccuuaaaacauuaaacauuugaaacaaguuacuuugucuauguaagcaaaacugcuaaaaacacuaguugguauuuguuccuuuuguagugaugccuuugugugcuauuaaugaauaauauaggcacuaaguaacuccccuguuacuacuguagagauuggagggucugggcugggggguagcaggggcacaccacaaacgucuucaccuccaugaagcuguguggugacacagggaacuguuuagguucccacacaccaguucaguuauuauaguguauuuagaaauuuggggauagugucauucauugauucuacaaugcccauuuuuuccuauuucagcuccucugaauucaggauguaucuuaauuaauggcaucagcaauucagugaaaucuaguuguugccaacaacugaucacggguuuguuauuuaaaaguccagauuucugauuucacuuuaaaaucagaauaucuggcaacagcugcccucauuccugcuuugaccuuuccuuuucuuuuuauuuaaagagagagggucucacuguguugcccuggcuggacucaaauuccugggcuuaagugauccuucugccucagccucccaaguagcuaggacuacaggugcaugccacugcacccggcuguuuagaccuuuguauuauggaacaugggcugacugauuccccauguugaucauuaaguccaguaaacugguuugggauuaccugcuuggucccuguagauauucaagaaacucuguuauuuuuuacucauuuuuagguacacguagaaacaccccaauuucaaagcuaauuuaucuguuguuuuuaaucacgaguccucuccuucugcacuaucaagugucuucuacuuccugcuuaagucucuguuguccauuucauuaagacagaaguuucuauuauuguuaaauuugaacuguaucuauguuauaauaguaaugguaacucaauccaaaggaccuaauaacaggaaguaacaugucuuacauaucaguuuauauuuguuuuuuuguagggacauacugugaucuugguauacuuguaauuuuuuaguuuccuggucgguucagugcauuuauuuauuuauuuuuuuaauuuuuguuuuuugagacagaguuucgcucuuguugcccaggcuggagugcaauggcacaaucucggcucacuacaacuuccgccuccuggguucaagcaauucuccugccucagccucccgaguagcugggauuacaggcaugcgccaccaugccuggcuaauuuuguaguuuuuaguagaggcaggauuucuccauguuggucaggcugaucacgaacaaaugaacuuuuuaaauugguugccuuauuaaauaguuaggaagauaguggaaagauauaucucuguaaguagguaaguaaguaaauauugggaagccagaaaccuaaguagauaguuuuucccccuuuauucguggagucaagauugcucauguuggaagccaguuagucauucaggaaaacagggaaguucccagauuccuuauacuggaaaaguuugcuugcuuucuuauuaauuagcagcaacuauaaugagaauugauucagauaaaauaaccaaauaguauauuuguauggcagcagucagcucuguauuccaagggcugauacccuagcaaugaaacacuguuaaaagaagaugauuaggaacaggauauacguccauucccuagauauacuuauagcagggcaaauugagauuccugucucauggcaauuuguaaacagcuuuuccgcuaaagcaaaugaguuugaaguccuucagagacucagucuugaguagagagguuguggggagaauacauuuaaaaacgaauugugcuggucuuccccuugcagaaagcagaaaauggagauuuaaauuggauaauaccagaccgauuuauugccuucuguggaccucauucaagagccagacuugaaagugguaugugaaauuauggcauuaaucucauuuuguuauugaaaauaucuauccuauauuuucuuuugaaagaguuacaccaagcuugaccaaguguuaauuauuauuuaagcauacuuggucacuucaguagaucauucugacuggauuuuaacuuucuuuucuuuuguuuuuuacaguuauaaucaaauugguauuuaauucccaguccagauacuguuuccguucaguuacaggugaaacuauuagccauuguuuucuuuauguguuuuauaagaucuggugcauuucuuuauguagguuaccaccaacauucuccugagacuuauauucaauauuuuaagaaucacaauguuacuaccauuauucgucugaauaaaaggauguaugaugccaaacgcuuuacggaugcuggcuucgaucaccaugaucuuuucuuugcggauggcagcaccccuacugaugccauugucaaagaauuccuagauaucugugaaaaugcugagggugccauugcaguacauugcaaagguauguuucuaggggugguuaaagaauaguauacaguaugaguauaugaauauguagaaacagaccauauucauuuaguuuaugugucagaacaugaaacugccuuuauuuuuagagugccgugaaaccuuugauuucagaugaaaaguauaguaacuuauuuucauaaguaauucuacaaauacaucacauugaaaugcauuuauuuauucaucaaauauuuauugggugcauccuauauaauucuaggauacaucaaugaguagcguagacuguaagagccugucuuaauggaaacuauauucuuaacaaguugcucuguuuucagcaauuguaacagugccuggcacuuaauagauauuuuuugaauaaaugaaugacuauacaauaauaaaugguaugaagauaguaggauuuauuuaacucucuuguuaguuaauuaagaaacaagaaauauaguuuuguuacaaaaauccaauauuggaaaaaaagcucagcaagccuuggggaaagggggagacugaucuccagaguuacugcuguauuuguaguuuuaaauauaauggcaaaacaucacauuucaguuuuuauugaaaaauuacauggcauacaaagaaacaggaaaguauagccuauucaaagggaagaaauaaauccaggccgggcaugguggcucacgccuauaaucccagcacuuugggaggccauggcgggcggaucgccugaggucaggaguuugagaccagccuggccaaaauagugaaacccugucucuacuaaaaauacaaaaaaauuagcuggguguggugacggauaccuguaaucccagcuacuuuggaggcugaggcacaaaaaucacuugaacccggaaggcagagguugcaaugagcugagaucaugccacugcacuccagccuggccaauagacagaacaaaaaaaagaagaagaaauaaauccacagaagcuaucccugagaaagaucaaauuguggacuuaguaggcaaaaaauuuuaaauaaccaucuuaaagauacccaagaguuaaaagaauaugugggaaaagucaaggaaacgauuuaugaagaaauacuaauaucaguuauaaaaagaacacauaaaagggaaccaaaaggaaauucuggaaauguacuaaaacugagaugaaaaauucacuggagggauucaaaagcauauuugagcaggcagaagaaucagugcgugugaagcuagaaucauuaaagaauuagcaagucugaggaacagaaagaauaaagagcauaacauaaaugaacagaauuuaagggaucccugagacacacccaaguagaccaagauacagaucgugggaguuccagagggagaagagaaguaaaggagcagacagaugauuuggcugaaaacuccccagauuugauauaugcaggaauauccaagaagcucaacaaacuccaagcaggauaaacucagaggcccaugugaacaugcauuauaaucaagcuauaaugccacagacagucuugaaagcagcaagagagaagugaccuaccacauacaggggauaccacugagauugucagcagaucucucaucagaaacauugcaggccagaaggcaguggguugauauauucaaaaugcauaagugagggaaaaccuguuaagaauucuacaucuggcaaaacuccuucaaaaauaauggaaaaauuaagacuuugcccaggcaaucaguuugccuuucugauaaaggcaaauacauggaccauuauaaaagcuaguauuaucguaacgagauaauuuguaaaauauuauuacuguaacuuguaaauauuguaacuugcaaaaaacaaauagaaaaucugaauagaccccuaacuaguaaggggauuaaguaguccaaagccuccugacaaagcaaaaccuuggauauaauaacaucgccaguaaauucuaccaaacacuuaaaagggaguuuuuaaucacuagaucugacuugcaagaaacucuaaagggggagucuuuuagguugaaaugaaggcacacuagacaguaacacacagccauuugagaagaggaaauaaagauuucugauaaaggcaaauacaaggaccacuauaaaagcuaguuuuauuguaacaagauaauuuguaaaauauuauuacuguaacuuguuauuguaacuugcaaauauuauaauauguaaauuauuguaauuuguaaaauaauuugucguuugcaaguaguauaauuuuuguguauuauuauauacaaaaauugcaaguaguauauuauuguaauuuauaaaauagagaguagaaaaccaauagagaaaaugaacaaaaccaaggguugguucuuuaagaagaauaacaaaaaugauaaaccuuuagcuagaaugaugaaguauaaaaggaagaagacucaaauuacuaaaauuagaaaugaaaauggcauuaccacugauacuacagaaauaaagcugaucaguacguaaaaaugaucaguauuguaggacaacaaauuggauagucuacaugaaauggacaaauuccuagaaaaacaaaacaccagaacuaaaucauaaagaaauagaaaaucugaacagaccccuaacuaauaaggagauuaaguaauccaaaaccuccugagaaagcaaaacccuggacaugauagcaucaccaguaaauucuaccaaacacuuaaaaaacuaaaaccaguccuucucaaacucuucugaaaauuugaggaaaaaggaacacuuucuaacucaauaaggucagcauuacccugauaccaaaaacaaaaagacacuauaagauaacuaacuauaggccaguaucccuuacgaacaucgaugugaaaaccuugaacaaaauacuagccaauggaauucagcagcauauuuaaaaggauugugugccaugaccaaguaggauuuaucccaugauuacaagagugguucaacauaugaaaaucaaucagugugauauaccacguuaaggacaaaaaccauacgaucaucucugcacaaaaagcgucugacaaaagucauuacccuuuugugauaaaaacacaguacaaacuagguauagaaggagauuaccucaacauaagaaccguaugugaaaagcccacagcuaacaucauacucaauggugaaagacugaaagcuuuuccucuaagcucaugaagaagacaaggaggcuugguuuuguggcuucuauuuaacaugguaauggaaguucuagccaaaggaaguaagcaaaaaaaaaaaaaaucgaaauuagacagggggaaguaaaauuaucuuuuugcagaugauaugacuuauauguauuauagaaaacccugggccaggugcaauggcucuuggcuguaauccuagcacuuugggaggccgagguggguagauugccugagcucagaaguuugagaccagccugggcaacacggugaaaccccgccucuacuaaaauaccaaaaaaaaaaaaaaaaaaaauuagccgggcguggcgcaugcuaaggcaggagaauugcgugaaucugggagguggagguugcagugagcugagaucucgccacugcacuccagccugggggacagagcaagacucugucuccaaaaaaaaaaaaacagagagagaacccucaagauuacgcacacacacacagagccccugcuagaauuaauaaaugaguucagcaaagaaguagcagcauauacaaucaacaggcaaaaaucccuuguuucuaagcccugacaauaaaaauauaaaaaagaaacuaagaauacaguuucauuuauaauagcaucaagaagaaucaaauauuggggaauuaaccaaggagaugaaagauuuguauaaaacauuuuugaggaaaauuaaagaagauguaauuaaauguaaugacaucacauuugugcacugggugacuuaauauuguuaacaugucaguauugcccgaagggauauacagauucaaugcaagccugucaaaauuucaacauuucuugcaaaaauagaaaaaugauucugaaauucauuuggaaucucaagggaugccaaauggccaaaacaaucuugagaaagaauaaaaagguuggaggacucacuuccugguuuaaaacuucauacaggcugggcaugguagcuuaacaccuguaaucccaguacuuugggaggcugagacagaaggauugcuugagcccaggaguuuaagaccacccuggacagcauggcaaaaccccaucucuacuaaaaaauacaaaaauuaacuggguguggugguguuuaccuguagucccagcuacucgggaagcuuagauagcaggaucccuugaaccugcgagguugaggcggcagugagccaugauugugccauugcauuccagccugggugacguagugagaucccgucucaaaaaaaaaaaaaaaaaaaggcuuaguacaaagcuacaucaaucaagauugugugguacuggcauaaagacagauacauagaccagugauaggauagagagcucagaaauaaauccuuguguauauggucaaaugacauucaagaaggauacagaaaccacucaauggggaaaggacagucuuuucaacaaauggugcugggaaaaccugauauccacauguaaaagaaugaaauugggcccuuacauaacaccauauacaaaaauuaaaauggaucaaggaccuaaauauaggacuuaaaacuauaaaacucuuagaggaaaacagagggugaaaacuucaugacauuagauuuggcaguaauaugacaccaaaggcacugacaaugaaagaacagacaaaucggacuauauaaaauuuuaaaacuuuugugcaucaaaguauacuaucagcagaguaacaagguaacccauggauugggagaaaauauuugcaaaucacuucugauaagggauuaacauccagaagauauagagaaaacgccuaaaaacaacaacaaaacccaguucauaaaugggaagaggacuugaauacaccuuucuccaaagauauaaaauggccagugagcacaaguaaaguucucagcauuuuugacuuauagggaaagucaaaucacaaccacagugagauaccacuuuauacccauugggauggcuguuaucuaaaagaacaaaaacaucaccaccagaaaauuacaaguguggagauguggagaaaauuagaagccuuguguacugcuagugggaguauaaaacaaugcagcugcuauggaaaaugguguggcaguuccugaaaaaauuaacgucauucagcaguuccaucucugguuauaugcucagaaacaauugacagcagggauaugaacagauauuuuuacacccauguuguagcagcauucuucuucuucuucuuuuuuuuucuuuuuuuugagauggacuuucacucuguuucccagacuagagugcuguggugcaaucuuggcucacugcaaccucugccaccuggguucaagugauucuccugccucagccuccagaguagcugggaugacaggcacgcaccaugacauccagcuaauuuuuguauuuuuaguagaaacaggguuucaccauguuggccaggcuggucucgaacuccugaccucaaguaguccacccgccuuggccucccaaaguucugagauuacaggugugagccaccacgcccggccagcagcauuacucugaauagccaaaagguggaagcaauccagguuuccaucagaggaaggcuaaagaaauggcuaaagaaaaugugcuauaucauacaacagaauauuaugcaucuuuagaaaugaagaaaauucugacacauguacugccacauggaugaaccuuaaagauauuaggccaauuuagguuugccagucagaaaaggacagauauuguaugaauccaguuguaugagauacuugggguaagagaaaguagauuggugguugccagggccugaggggaggcagggauugguaguuauuguuuaauggguccagaguuggcugggcacgguggcucacgccuguaaucccagcacuuugggaggcugaggugggcggaucacgaggucaggagaucaagaccauccuggcuaacacggugaaaccccaucucuacuaaaaauacaaagaauuagccaggcuugguggugggcgccuguagucccaguuacucgggagucugaggcaggagaagggcgugaacccgggagguggagcuugcggugagcugagauugcgccauugcacuccggccugggcgacagagcaagacuccaucucaaaaaaauaaauaaauaaaaauaauaaaaaauaaaaauggguccagaguuuccguuuuguaagaugaaauacguucugaagauggauggugguaauguuuguacaacaaugugaauguacuuaaugcuacugagcuguacacauaaaaagugguuaaaaugauauucagaaacuuacacuaaggaaauacaaguuuccgaauuaaccaauacagaauuuuuuuguuuuuguuuuugagacggagucuugcucugucgccuaggcuggagugcaguggcacgaucucagcucacugcaaccucugccucccagguucacgccauucuccugccucagccuccccaguagcugggacuacaggcgcccgccaccgcgcccggcuaauuuuuuguauuuuuacuagagacgggguuucacuguguuagccaggauggucuugaucucuugugauccaccugccucggccucccaaagugcugggauuacagguguaagccaccgcacccggccccaauacagaauuuaaaauaacugucuuaaacauguucagugagcuaaaacagaauucagacaacuaaaugaaaucaggaaaaugaugccugaagaaaaaugguaaauuuuauguauauuuuacuccaauuuuuaaacauaauuaaaacaaaagccagcauugcuuauuucauuuuuuaauuauaaaaagcaguugaaggaauucuucagcaagguccuuuugcaccccaaccccaucacacacccgacauuuggcaaccugcagagaccuuuuuuggggguuggguaccacgggcaucugguggguagagaucagcgaugcugcuaaacauccuacagcgcacaggacagcuccucacuauaaauaauuauccagccucaaauguuaguacugcugagguugagauacccugaaauagaaugaugaccaauuaaaagccuagagaggaucuuauuugauugcaucuuuguuuagggaagaaaaaugaugacaguaugaaaauugggcuguacagugaaaauugagauucauuaagagguauauuaaucugcuggggcauaucaccaacuggguggcuuaaacaacagaaguuaauucucucacaguucuggaggcuagaagucuaagggcaaggcacuggcagggauguuuucuggggaggccucucuccucggcuugcagugcagaugucugucaucucugagucuucucaugguuugcacuuaacuccugccgucucuuucuuuuauuuuuuugagauggagucucgcucugucucccaggcuggaguaaaguggcgcgaucucagcucacugcaagcuccgccucccggguucacgccauucuccugccucagccucccgaguagcugggacuacaggugccugccaccacgcccggcuaauuuuuuguauuuuuuaguagagacaggguuucacuguguuagccaggauggucucaaucuccugaccucaugaucugcccuccucggccucccaaacugcugggauuacaggugugagccaccgcacccggccuaucucuuuuuuuucuuagaaguacaacaguccuauuggauuagggccccacucugugaccuuauuuauuuccguaaaggccuuaucugcaaauacaguuguauugggacuuagaacaauauauggauuuggguuaggggggacacaauucaguucauuauauucugccaucuggccccccucaaauuuaugucccuucacuucaaaaauacauucaccccaucucaacaguucugaacaucucaauucauuccggcaucaacuccaaguucagagucucaucuaaauagcauccaacucagguauaggggagacuugagguaugauccauccugaggcauaauuccucccagcugugaugggaugguacaggcacaggauagacauuaccauuccaaaagggagaaaccagaagaaagagcuucuaagcaaguccaaaaccuagccaggcaaaucccauuacaucuuaaggcuagagaaucauccucuuuggcuccacgcucugcccuccaggcccucuaggguaguggcuuugucccugagggcuguggucagaggcagcuggguuugcuguaacuaauagagguggcccuacccugugaaaucaaggaguaggcaggccuucccugagcuuauauacucugugucucgguggcaguggcagcacugggggucucuaaauugcccuugggaucauccuuccuuuucuugaaggacaaagaauguuugcauccagguagcucugcugucagaaguccaaaagccuuacuuuauuuuauuccauguccauccccuuuagugcaagaugccagugucucugcugguauaaucccaucucuuguccuugcuucugcugagauggcugauuaagucuagguaaucucuuuagagggggaguguccagccacacccuugacuuuucucucuguaacacucuuauuuuuugcaauauggauagccugagaauuuucugacucuaguuccugauucccuguugcuuaacaauuucuucuuuaauucgucuuuuuccuuuugcauuuuacaguaaccaguaaggagaaaccagguuguaucuucaacacuuuccuuacaaaucuccccugcuaaauaugcaagguugucaaucacaaagccacuucuccauuucuauguaguuguuacagugaccccuaucucaugauccaaaucuguauuuaggguucuccagaaaaacaagcaguaggauuuuuuuuauauguaggagauuuauuaaaaggaauuggcucaugcaaguauggauucuggugaguccaaaauaugcagcgugggccagcagccuggaaacaugggagaguugauggugcagaugaaagccaaaggcagucucuugcucaggaaagucaggguuuuuguucugcccagguuuuucagcuaauuggauggggcccauccacauuauggagggaacugugcuuacugaaagcucaccaacuuaaauguuaaucuccaaagauucauuccggauugacacauaaaauuaaccaucacuggagguaaugauaauagucuagauaagacaggccagcaccaauagagguuuaaaaaaaucugagugaaaauggguauuacagaccagaaaacauaauuggaugugggaguaagugcaaaauuacaagccuuugguuuugcaaagauggugguaccguuuuucuaaaaugcccagggcagaagacacugcacuuacugagaaucauugcucagaaagugauucuccaccucggcuacacauagaaucaucuggaagauuuuaggaaucucuguguccaagcuaugcugcauaccaguuaaaucuaaauucuuggcguaaggccaggcgugguggcucaaguguauaauaccagcauuuuaggaggccaaggcaggcggaucaccugaggugaggugaguuugagaccagcuuggccaacauggugaagccccgucucuacugaaaauacagacauuagccggcugugguggcacauggcuguaaaucccagcuacuugggaggcugagguaggagaauugcuugagcccaggaggugaagguugcagugagcugagauugcaucauugcacuccagccugcugggcaacagagugagacuccgucucaaaaauaaauagauaaaugaaacaaauaauaaauacauuccggaugugagaccgggcaucaguauuuaaaaaccucucuaggugauuccagaguguaaccagccuugagaaccacuauugaaagaagcagagucaugagaagccuuuuaaaaaaauucugccugcccaacaaaauccuggaguacaucagcccaaguuucauuucugugcuucuuuauuuuccuagcuggccuuggucgcacgggcacucugauagccugcuacaucaugaagcauuacaggaugacagcagccgagaccauugcgugggucaggaucugcagaccuggcucggugauugggccucagcagcaguuuuuggugauguaaguaguagccuacgucuguaguucccagggaacaugugggguuggaaucugauggggaguggaauuuccuuuaguuuccaacaacaacagauaaucugguaggaagaaguuguucauguaucuuucuggaaagcucuauuuugauguuauuuaaaugcucuaggaagcaaaccaaccucuggcuggaaggggacuauuuucgucagaaguuaaaggggcaggagaauggacaacacagagcagccuucuccaaacuucucucuggcguugaugacauuuccauaaauggggucgagaaucaagaucagcaagaacccgaaccgguaaucaagccguuucuguugcgauguuguuacugcuuuaacugcuauugagaaccugucaggguauggagaaaaccguagguaaaauaauaaagcagcucuuggaugauugucaguuuuuuauauuuauaacccucucuaggcacuuuuuacccaaaauaguggaaacaagguuguguguccauaaaacuauguuuuacuuacucagcaggugcauaaaagguugugaagugagcucuucagccagaucuaccccugccccucaccccuuuuugccauuucacaacagcugauuuaggaaagcaaucauucucaaauagagagcuuuuaacaaaucaaaggcuuaggggguagcaguacuacuacauuaagugguaguaaguacacugagauuuuaaaaagagcguuuucaaacuugaaagcccauuaacccucuucacuguugauguguuuucuaacaagagugcugcuguguugucucugaaagucaacuuuggcugucuuaaaaugucaccugaagcuugauugugaaagggaaaaauauucuagagcuugcagaaacuuggacuguguucauguggauaaauugcugcucugcuguacugcauuaauaagugcaacuuaaaucauuagcucaguguuuuuuuacuuacacaguacagugaugaugacgaaaucaauggagugacacaaggugauagacuucgggccuugaaaagcagaagacaauccaaaacaaacgcuauuccucucacgugagucuggguuccuuuguugugguugauguuucuucauaugugugugggguccuuggugaggguuuuuccuguacauuuuucuccauaguugcaagcccaugaugccacuuugaaaugcuugccuauguuauuuaaaaccuaggggugcuggccuuggaagcucucagcugucccuuguuuaccuugguccucaugagccuuuaugggugggaaggcgacaucagggauacuuuuucuccaugaauaaucagcauggggcauccucaggagcgcgacagcagauguaaagcccaggaugccagacuuguccauaguuacuaaagugguguauuucuuuacauuugccauguugcagaucauuuguuuugauaagcaugacaugauggcuuaaugacauuauguuguuuuggggcaacaaugaacuggucuaaacuauauuuuggguuuuucguuuguuucuuuggggaaugauuuucuaauuauagaggaagauuuagccugagaauaggaaauguuguaguacugaguguauguaugucuauguguacauucuugugaauguguguuaguugggauucaaccugauggagcauccaagauuguuagaaaaauaugcagaagcaaaguacaugaccaugguauuuuuuguaggcuguucuuuaguaaaugcucccacuuguugccauuggauuucuuccuucuaguuacuuccuuuuucauugugggacaccagauuuccagccuucuuuuuugcggggagggagugugauggacauagaucauuuauucaguaagcaucuuguaauaugguaaggaaguaugauauaauauaccauuuauauuggcagagaacagguuuucuuuucaauuaaaaguaauuccucacuagugucucgucauaaaaauucugaaguagaauuacaccuaaggcaugugucauuauggguugcuccccugggagguucuucuuaaaagacccaaggcaaagaauugaguuuuacaauaugcaguguuaugugaaugaauguagggcauccauuuugauuauaggcauuuauuaagcauuucuuuugcaacuuagugguacuuuagucaacuauacuuuuuuaaaaauggugccuuuuggccaggugugguggcucaugccuguaaucccagcacuuugggaggccaaggugggcagaucaccugaggucaggaguucaagaccagccuggccaauauggugaaaccccgucucuacaaaaauacaaaaacuagccgggcaugauggugggagcuguaggcauuauaggaucccagcuacucgggagggugaggcaggaggaucgcuugaacccgggaggcagagauugcauugagccgagaucgugccauugcacuccagccugggugacagagugagacucuaucucaaaaaacaaacaaacaaacaaaaauagugccuuuguauaauuuacuuaacuccaaaugccauuuuguuuuuaauuuccuuauuaaaagucuucaccuaaggccuuaaugguuuuucuuuggaaguauuaugguggcuccagguaaucauccagauacuaauucuggaugugguggaggaggcaggcagcacccucgagcagugcuucucagacuucagugugcaggaggcacccgggcgcuuguugaaauauggguuaugauuggugggguggggguggggcccaagaguucacauuucuauccgaggcugcugguccagggaccacacauugaauugcaagcccuaggaaacugaugcuuuuguggguugauuuuagcugugucugggauuuuuuguuuuguuuuucagaaucagcaucaucaguuuauguuuuaauauuuuguugccugcuguucaaaagucaaguugagagucaggggauacaaauccugcuuagucaaaaguuuuuguuaaauaggaaauuuccuuuagucacccucugaaucugcuacucucauuaacgugaguucaaaucuagcugggcguggcugugcgcaccuguagaccaggcuaugcgggaggcugaggcaacaggacuacuugagcccaggagucugaggcugcagugagccaugaucacugcauccagccugggugacagagugagacccugucuaaauaaauaaguaaaaucaaguacaaugguaaaaguuaaaaaacaaagagguagcucaggauuccuuuugguaauaucccaaaaacaauauauauaaauagccccacauaacacaaauaacaaaguuuuaggccacacuuuuaaagaagaaagcgaaaugcuaguuuuucuaagcucugaguuauguguauagacccgaggggauuuuugaugagucucagcaaaucuccuuccuccucccuuacaacauuuugcuuauccccgucucugcuuuuucaaacccucucugcuauuauuugcaguuuuuuggcccuagaaaagaucaauugaagauuuucuuucuuucccucuugugucuauguuguuauuuuaggaauagaagucccugagggacuguucucaacaguugcuuggguugaaaaauacaaaaucaauuucuucauccaaguuugacucauugauuucugugagcaaguuauuuugcuuuagcauuggcacuuagccuuaugaaaauacaguacaugcaagaaggaaaguuagugagaaauacacaaguacuagugauucuuaggagaagguuauaguacauaaaauauuauuccaaugauugguuucucuuuuuuuuuuuuuuuuuuuuuuuaagacagagucuugcucuguuggccgggcuggagugcaauggugugcccucggcucacugcaaccucugccucccagguucaagugauucugcugccugagccuccggaguaucugggauuaugcaccaccacacccagcuaauuuuuuguauuuuuaguagagacaagguuucaccauguuggccaggcuggucucgaaauccugaccucaagugguacacccaccucagccucccaaagugcuaggauuacaggcaugaaccaccggcgccuggccgguuucucuuuuauaaauggucaguuuugggggagaguuuaaguuuuuagugauuauaaaauggccauuugcucagccugucugauccugacuacaaugaugacaggaaaccauguggcaccaugacauugagcugaucuucaggacgugaugacaaguauauugucugugcuaaaauggauuugguagauugcauaacuugagccaugaggccugucguucugcauacugaugguuuugguagguuuggagaugaguauaucuguuagcaauggaaaauaauucuuuuuuuauuuuuauuuuuuauuuuuauuuuugagacagaguaucgcccugucgcccaggcuggaguaaaguggugcgaucucggcucacugcaagcuccgccuccugggaucaugccauucuccugccucagccucccaaguagcugggaauacaggcgcccaccaccacgcccggcuaaauuuuuguauuuuuaguagagacaggguuucacuguguuagccaggauggucucgaucuccugaccucgugaucugcccaccuuggccucccaaagugcugggauuacaggugugagccacugcacccggccggaaaauaauucuuaagccaugagguuuacuagaggaaaaaguaaccaucuauaaugcugacacuuggacauucgggccauucugccuuuaaggaacugaaggugaaggcugggaucgguagagaguucucuagggcucccagaccauuuauucauuccauuuaaauauucaccccugugaucuuuauguauauuaguagcuuguuuuuuuugugggaagauuaaauaagaugguguggguauaacuugugggguaagguuaggcuguauuucgaguucacccuuuagucuaaucccuuuccacaauauaggaugccuggcauguaauuucuuuuuccccgagacagagucuugcuuugucacccaggcugggguacaguggcguaaucuuggcucacugcaaccuccaccuuauggguucaagugauucuccugccucagccuccugaguagcugggaauacaggcacacgccaccacgccucgcuaauuuuuguauuuuuaguagagaugggguuucaccguguuggccaggcuggucucaaacuccugaccucgugaucugcccgccucagccuccuaaagugcugggauuacaggcgugagccacugcgccuggccugacauguaauuuuuaaugaugacagugaugaggucaacaauaaaaaugacaugauaagccaaaucagccauuuccaaauugauuagcaguacucugcacacagcagaugcucaguagaggcucuaauauuuggucacagauguauccaggugaccauuuggaaguauagucauuggaaagagcuucugcccuuccaaaugggaggagguuuccuuccucacugcuagaacccagaccaauggauuaagaaacaccaagcugaggcuggacacaguggcucaugccuguaaucccagugcuuugggaguucaaggcagcaggaucacuugagcccaggaguucgagaccagccuggccaacauagugagauucugucucuacaaaaaaaauaaaaaaaaaaaacugggcaugguggcaugaacaggcagucucagcugcuacucaggaggcugaugugggaggauugcuugugccuaggaguuggagguuacagugaacuaugauaacgccacugcacuccagccugggcaacagagcaagaccccuguuucuuucuuucuuucuucuucuuuuuuuuuuuuuuuuuuuuugagacggagucuugcucugucgcccaggcuggagugcaguggcgcaaucuuggcucacugcaagcuccaccucccagguucaugccauucuccugccucagccucccgaguagcguggugccugccaccacgcccggcuaauuuuuuguauuuuuaguagagacgggguuucaccauguuagccaggauggucuugaucuccugaccucgugauccgcccgccucagccucccaaagugcugggauuacaggugugagccaccacgcccggccuuuauuuuuuuuuauuuuuuuuauuuuuugagacagagucucgcucugucggccaggcuagagugcaguggcaugaucucggcucacugcaaccuccgccucccgagcucaagcaauucuccugccccaacuucccgaguagcugggauuacaggcauaugccaccacgucuggcuaauuuuuguauuuuuuuaguagagacgggguuucaccauguuggccaggcuggucucgaacuccugaccucaggugauccaccugccucagccucccaaagugcugggauuacaggcaugagccacugcgcccggccgaccccuguuucuuaaaaauaaaaaagaggcagggugaggucaggaguucaagaccagccuaaccaacauggagaaaccccaucuguacuaaaaaugcaaaauuagcugggcaugguggcacaugccuguaaucccaguugcuugggaggcugaggcagaauugcuugaacccgggagggggagguugcagugagccgagaucacaccacugcacuccagccugggcgacaagagugaaacuccaucucaaaaaaaauuaaauaaauaaauaauaaaauagagcucaggugcgauggcucacgccuauaaucccagcauuuugggaugcugaggcaggcggaucaccugagaucaggaguuugagaccagccuggccaacguggugaaacccuguauuaaaaauacaguacuuagccgggcguggugaugugcgccucuaaucccaacuacucaggaggcugcagugggagaauuguuugaaccugggaagcggagguugcagugagccaaaaucacgccauugcacuccgggcugggugacagagcaagacuccaucucaaaaaauuauaauaauuaaaaaauaaaaaauaagaaagaaacaccaagcugaaagccaacuaguaugaggaaaaugaguguggaaaacaacuaagaaaagucuauaguaugcauaccuaagugaaauuuugcucauuuuguguugcccuggguuaaaugugaaccauauuauaaaaaugugccauucccuuagcuuccuggauggcucaggaguuaguaacucccuugaagugagaucaguucugcuguauuacguucauuuuuaguugugccuccugugauuuuguuaacuagucugggguuuuguguuuuuuuguuuguuuguuuuugguuaucugguuuugccuccuuugccccuugugguuugcuuuaguuuucugugugugcacaucuucugcuuuuugaagaaccucaaucauuuaucugugacugauuucaguaucauaaaguuaaauuaacaugggguaguuaucucacuagugacugagucccaaaguaugaaaccuguuuaaacacagcauuuuuuuauucaacauaaaauggcaaaacuccauccuuguugaccaccccuuuguaucccuguugcuguuggcugggcuuuuagggugucuaaaauucacauauggcuugauugauugaugauugcguaauuuauuuuggcuucccaauuugaacaucuguucuuuccccuucaccccuuuccagauguccccuagcugugcugaccucugcacuguguaguguugucaucugguggauuguuugugacuacauucuucccauccugcuauucugucucgaugguuucagaacacaguagccaucaggacccccugacagauagcugcuguaagugucccguucuguuucucugccguugcuuacuucuggugccuagugugguucccacaaugcauguuuuucuccuugucagcuccuagcuuuguugguuugccuauuuucaaagguucuuuuucugaaucuuuucaauuaaugggauggugguggggagggaaggugggcuucacuguuccucucauagaaaggauauugaaaguaacauacguuguuuuaaaguuaugcuuauccuuaacauauuucaaaauagcaguugauaaagacacugaaacaguuuuucuucacugaaacaguuuuucuucccuaucaaaaguaguuagcuuaggauaauuggggugguuuuauuuucgucaguuggcuauacaauuucccucuaguuuucuguaucuugaguauguccuucccagucuagcaaagaagcauuuuucccacugaucuacuuucauuaaauaugugauuuuguagccucgaaaucugccauuguacagcagcucucucauaagucuucucucuuuagugugcagaauuuccugcucugucucauuuuccuccuccccuuuagggaauacaguaaguacaguguguagcacuugaugcuaaaugaaaguaggaggucggagcugaggucgccuguuuaaauuggugcauuuccauaugauggucauuguuccugcuuuucuccuugcccagacauagccagaaugccuuuaauaggcuaauagcagcaaaucuguauucucuugagaucuuucaucuuugaaaugaagaccuuaacagcgaagaggcuuuauuucugcagaagaauguacaagaggcccacuuguggaacagcauguugaagacccccagaaggcggguguguccgugucacgggguccaccgccacccuucugugucugagcugcguucuuccuucucugaagcuuuuuccuuaacucauauuuuaagaauuucuucucuugucuccucuuggacuuggaaguuaugaaagaaugcaaaaguuccuugcaagaucucuuccaaagaaaaauuccauugcaaccaacucugguacuuugugguuucacugaguauuuucacauagcugagaaagauuuaaaaaucaagcugauuucacucuucagaauuaggcaaaaccugcuuaacuugcuccuauuuauggcauuuucuugaauaucuuacaaauaaaagcuuauugucgcgcauucagaccugcuguauuucugagauagauuaaccuuuuggguguuuucuucuuuacuucucuuagucaacuacgauugccacauauucugacucaagagcaucaugcacuacauagaguuauucuucucaaacuguuccaaguggcaaagauguucugaauggguggagcaguugcaaauaaugcuuaggcacuuugugguugaaugaucauucccaggguaaguuuaaacauggucucuaucaggcucucuucuuuucaguauuccauguaaacuauaccuucuguuguuauugguaaugacguuugccauuguauuucuagacccaagcagaguauucaguucagccugacuaauuauuuggaauuuugagaagcaaaaagcuugugacaguuacagugguguuaaucaguaucaucuuuguagcacccccaugucuuucucucaaaaggguuuuauuuguaagguggugacuccugagcuccaccauccucugucaucaccacccaccucugcuggcaguggacgcaggugguguggcaucgucugcuaaguuguuuccagugaaaagcuccuguuaugcagcaugccuggagaauuaggccauaacaacacuucaggcuucugagucagacucagagauagugggaaagccuucucuggaggcugcagggccucagggucaccuuugugcacgcucuugugguguccggaguggacagccaguauacauagugcauaguugcccugauggauuuuuuucuuggaauuggacauuuauguucgagaccuggcuuuuuaguuuuuggcuuugccguguuccuuggguugcagauuucacuauaucugaaaucucagaguaccgaggcuccaaggaugcugcagagaagaaggugaacuggaauauaggcaagagguagguaggauggaggauuuugucagggcagaugggaaggaagaaaauacaucugcugcacacugcucugcaaagccaugcuuggccuggguuggaaggcagaaggccgcgagugcccggguucccugugacagaggcaacacgucacccucuggugccugucagguggugugugcugucacucaugauagcucaguggaguucucccccaaccccgauuucaucagugcauaaccugcaguuaggauaaauaccguguugucagugcaaauaacuggagucuuccguggugugguuaauacacucaaguucuaucauucucuugguuuuaaaguuccacagaaauuacuagcuauuuaauauuauuauuauauuaguucacuuuaauuuacacuaauuuuauagagaaauaaauacuuuuaaaaagauguuuuccagcagccugagaaugacuacaggauuuagcaguagugucuuguuuugaauggcauuuaaacacuucagucauaguuuuaauuugagaaaucaggauucagauuuccuaagcaggcaguguaucagcucuuguuuuuuucucagauuaauuauuuugcagugugauuguugucuguacuuuuggccaaccguggccucaaauuauuugagaauuagguguuguauuuaaaaaaaaaaagccaacaggagucuuguuuucuccgugcguaagggaguggccgaggggagcggaugagaacaguggcagcacgagugccccggccugggcuucagaaguagcaaugaagcagcagcaguuuguuuuguuuuguuugguuuuaugcaaaauucuauauucaaauucuuagcagagaugaauaaauauuuccccaucacuuuauauaaacaaauaauuuuuagggaugggcagacuggcucaugccuauaaaucccaacacuuuggaaggucgaggaaagagaaucacugaggccagaauuuugagaauagccugggcaacauagcgagaccccaucucuauaaaauaaaaaaugaaaaaauuagcugggugugguggcauguaccuguggucccaacuacucuggaggcugagguaggaggaucaauugagcccaggauuugaggcugcuaugauugcgccacugcacuccagccugggcaacagagugagacccugucucuuaaaaaaaaaaaaaaaaagaaaaaaaauuuuaaaaacaauuccuuguuuuuagaaguagaauucacaagccaggguaauaguugucuuuaaucauacaauuaagaugcauauacacucuucuuuuuuuuuuuuauacaaagucucuaucaccuggcuggagaucggugacacaaacauggcucacugcagucuugaccucccaggcucaagugauccuccuaccucaaccucccaaguagcuggaaccaaggcacgccccaccacgcccggcuaauuauuauuauuauuuuauagagaggaugucucacuauauuuuagaauuugggcuucuuaauggugucuuguuucaugacugaaaaucugagaagcuacuuuuacuuuugggcauaaagacuuguuuggcugguggauuucuuuggugugggaauugcuuaaaauguccaggcuggucucgaaauuuuggccucaagugauccuccugccuuggucucccaaagugcuggaauuacaggcauaagccaccgcaaccaccuccuuuuucuauuuuguuagaacauucaacauaucagaugaucacacucuaggagaauuucugaaccaaacauuggcugauuuauccaggauucaugucccucugugagacagaaagcuaguuucauggggcccucagaaauccugcaugaguaaagugaaauaguggggaaagcugcccauccccuucuccccagaaggcuugggaccgcuggcccagacaagcuccagguuaugcucugguugcggagucucgcucuuuggcccaggcuggagugcaguggcacgaucucggcucacuacaaccucugcugcccagguucaagcaguucuccugccucagccaccugaguaguugggauuauaggcaccugccaccacacucggcuaauuuuuguauuuuuaguagagacgggguuucaccaucuuggccaggcugcucuugaacuccugaccucgugauccaaccaccucggccucucaaagugcuaggauuacaggugugagccaccgugcccagccucuuguugcuuuuuuagugaugagauguuuagcauuuuacuaaauguuggauaugcuuugguuugggucaugcuaagguuguagaaauuuauuaaucuuagccuauuuuaaggcccugucuuugguauauuagccagcauggugguagcugaggcccgugaggugggaugcucacuaauuguaaugguucaacuuuuuacuccuuugagcuggguucucauaaguuguuauuggcuuucucaccuuuauguuugaauaggagagaagaaagcuuguuaagucaguauuuucucuuucagagaauuaaaaguugguaucuauaaauguguguauauguguuuaguuugucauugauuaucucuugaagaaaagaauugcauauaggccuggugugguggcucacaccuguaaucccagcacuuugggaguaagugaggugggcgaaucaccugagaucaggaguucgagaccagcuuggccaacauggcaaagccucaucucuacuaaaaauacaaaaauuaaccaggugagguggugggcgccugcggucccagcuacucaggaggcugaggcaggaggaucgcuugaaccugggaggcagagguugcagugagucgagaucacgccacugcacuccagccugggcgacagagcaagacuccaucucaaaaaaaaaaaaaaagaauugcauauaaaaucuuuugaugucuucugcuguuuucccuauaacaauuuaaagaggaaagaaaaaaaaaaaccaaaggaccaucugccucuuaaaggacauuccguguggccuuuaucucaggauguucuuuucugauucaucgugugcuuccuccugggcagccuacucucauaugcaccaguuucucaagcuuuuuagaguuuaauuaaggcaagcuuuacaaaauuuaaguguuuucacuuucauuuuaguggcacuuggagauuuaguaaguguuauauauaauucaggcaaaacucauauuuugcuuaaacacuuucuaaaauuuugaaacguuauauaaaauuaguauugauuuaguggauuauuacccauacuuacagcuuugaagagugaauauuguauaguuauuuccuaaauuuauguuccuauucuuuagaauuugagcucuuaauggugucuuguuucaugacugaaagucugagaagcuacuucuacuuuuguugggcacaaagauuucuuuagcugguggauuucuuuggugugggaauugcuuaaaaugccaagucauucgccuuccaggagcaaagcccucugguugucuuuguguaaccuucaaagagaaacgagaugcuucauuuuaaaaggccuugaugugaaaauguguuucagauuuuuuugguaaauguguugauggaaaauccucucaauucucaagauaauuugcacuaaagugcaaaaauacuuuccucugucaaguauuugcaaaugguuucagugaauauaaucuuauuuuuuuccaacuauuuucagaguaauucuucaauccaguguucagagcuguaaaacaucugaaccuaacauuucuggcagugcaggcauuacuaaaagaaccaccagaucugcuucaaggaaaagcaguguuaaaaggugagaaaagaauccuacucuucugaaaaguugcaagcguuuguuuuccaguuuaauauuuggacccuaccucuggagacugacaugaaauuaggagaaaguagagucucugugaugggaaauucaucaaauguguauuccuuguucauuaucuaagaaaaucuggaccauuuuaauguaggcuuuuguuuuguuuuuuagaaguaauucucaacacuggaaguauggucucugggucaugauaugggaaaguuuuaaguuaagaauuuccaaagcuggcugucaggacuuggaggacauuuuucuagguguauaucagauacagcaucauugcuggacgauuagcugcaaaugaaugugaugguagaaaugagauaaccagagaguuugaagauccuucucuaccuagugacucuuuguccucuuggccacagcccacacccgaggcacuaguucuuucacugucgucacugucuucagugaguguaggcagaauuucacaaggaaaccaauguguucuguggccacgucggugacucuguugucuuuggauauuucucaugaaguggacaugucauuuuuaaaguauucugaaaacagaucccaucugaagagagaauaaauagcccaggaguggaaguggggauagauggcucaggaguagaagggggcaccuuuucaucguugccugguguuggcagcccaugcaguccuguuucuguccuccugguaaaaacgaucucuucuaauagacaugagcgaccugaagauaaucagaaccagacuuuaaaauguccugcacguguacccugcuucuuuucagcuucccugccauguauauccgaggcuuugggccuaggggccuuaucagugugaaauuaguccccagugcaaagcagccagucucccaagagaccuuggcagagcugggaguucugugugcuuugccuuuugaagacucauucagcucugccaugucuccucuacacuguuuuguacaaccuuacugcacacuuaacacucgcauggggaugcagcagugccccggcauaaggauuggaggacugucaggcacugacucaugauuccaggauuuaaaauuuuucauuagaaauguaccaaauauuccuauuucuuuacuguuugauucuucuugagaagaauauuagagaaauacugaccaaaggucaaagauuucgguacauuggaacaauagcggaguguuauuuauaacagugagaaacaggaaaugggcucaagauuguuacauuaugccaaaugaauugggagucauacauuuaguuuaguacacgaagcaguaagugaaaagagccaugcauaacaauucugaaguaugggccgggugcgguggcucgcgccuguaaucccagcacuuugggaggcggaggcagguggaccacuugaggucaggaguuugagaccagccuggccaacauagugaaaccccgucucuacuaaaaauacaaaaauuagccaggugugguggcaggcaccuguggucccagcuacucgggaggcugaggcaggagaaucgcuuaaacaugggaggcggagguuucagugagucaugaucacaccacuguacuccagccugggcgacagagugagacucugucucaaaaaagaaaaaaaaaaaauucugaaguaugacucuaauuuuguaagcguaaguauacuauauauguauagaaauauagagauguauaaauauuuauauaccuacaauacaucuguauuuauagaugaguaaguuucuauauaugcauagaaauaagacaggaaaaauaugcuaugauacuaauaaaaguucugguuggugggacaguugggauuuuuuucuuuuuuaucgucuuauuuuccaauuuuucuacaauaaaugaagggaaaugggaguguuuuaacugacacuuuuuggugagccaagcuauuaaaaauucaggcugggcgcgguggcucacgccuguaaucccaggacuuugggaggccgaggcagguagauuaugaggucaggaguucaagaccagccuggccaagauggugaaacucugucucuacuaaaaauacaaaaauuagcugggugcaguggcgggugccuguaaucccagcuacucgggaggcugaggcuggagaaucacuugaacuuuggaggcggagguugcagugagcugagaucgcgccauugcacucuagccugggcaacagagcaagacucugucucaaaaaaaaaaaaaucaaauaaaaagccuaucguugaugacaguuaauuguuaauuuugacaugucuugaaggggcauauucuuuuuagguaugagugcucaggcuuuuuuuuuuuuuuuuuuccuuugacauggaguugcccaggcuggagagcaguaguguuuucucggcucacugcaaacuucgucuuccagguucaaaccauucuccugccucauccucccgccucauccucccaaguagcugggauuacuacuuguggguggcaugugccaccacaccuggcuaauuuuuguauuuuuaguagagacgggguuucaccauuuuggccaggcugaucuugaacuccugaccucaagugguccaccugccucagccccccaaagugcugggauuacaggcgugagccacggcgcccggccgcucaggcuuuuguuaacagcguagugugucuugcacauuuaauucugcuguuugcuuuuuuagauuaugcuuuuuagguuacagaagaguagaguccgggagccuggcuggcacuugccaggucauaucgucuuccugugaggaaggaagggcuggccuugccucuguuuuucuaucuaggucucguugcguuuucaugucacucuaguaaccugaacuccugccucucuggagaagugguuccugguugcagcaagcaucugccucaggucccuggcagggaugcuuugaggguccuaagguagauuucagagucaguaaucuggacugaauguugaaaugacccaaagcagcuuccaggaauuugggauaguucugaaaaccaaaaagacuucuuuuaaauuccaaaauggacuuucagagaugauguggagagcaaaaggagucuaacagugaggauuaacugggacucacaguuuauuuccccaccuuccucuaaguggguucuuucuuugugccucuuuugggacuuuguccuguguucacaucacccuaccuguuauccaccuacagcuuacaaaagaaaggcaaauuauguauagguuuuaagaauuggaguuagccaagcuguagccuggagcuuuuauccuacugaauauuauucauaauaucauacuaaauaguauucauuucuguuuggagggcaagagggaauuaguauauuggugcacggucugauucuggacaaaauaguaugagcuaagauuguugaguaaauuuaaaguauugaguugaaaucuuuaaacagcaguagaaaaaaaaauagagcacccuuuugggguccuuucaucccuaccugcaacguagcagguuuaccaguuccuacugguuugucaucaucucugcggcacaugggaacuugaccuuccauuuucauguuccuuggcauccaggaugaagacuccacccaaacucgcuuugcgcuuaauuggugcuuuugauuuuugguuuuacugagaggcucuucagcuuuggggaacuuuuucaaaaacgucaaaagagcaauuacuuggggcagcugaaaaaauaggagugaugucuuaacuauuugucuuugggaaaaggugccacuguuucucacagaagaugacuauccccucguguauccauuugaagcugugccacaucgaaaccuaaaucucauguggccacaggucugggacggcggccaggcagccuguguggcccucgguccugccagggcucuguguggcaccuucucauucccuucccugagucuggagagggaggugagugggcuucucuaccucccacuuccuguuagagcuauaaauccaugcuaaccuuucucuuuuaagaauuaauaaauccagugaauaauuggcuccguugaaucggccuguuuucaguguucucacaugaccucucugaagagcucucuuagaacagucuuggaaauuucaucaugccccgagugagagccugcagccaccucauuugcucgcauucacucaugucuucacgcagcccuuccgcuggugcguguuuguuagcuuaugcuguuucuuuugggcaggcucuucuuuuuuuaaaaugauaacuucauucauuuucuaagaaacuggcauguacaaguuacuuuaauucugaguuguaucacuaggaaccaucacuuucugcugcagcugccaaaccaaaccuaagguccggggcucuggagugcuuuguaccuaauucuucauauugugggggcuggggagagaaaugcucagguucuuuccuuagcaucuuuuuuuuuuuuuuuuaaaugagacagagucucacucuguuacccaggcuggagugcuguggugcgaucuuggcucacuacaaccuccaccucccagguugaagugauucuccugccucagccuccugcauagcugggaauacaggcgugcaucaccacgccuggcuaaaaauuuucuucuguauuuuuaguagagaugagguuucaccauguuggccaggcuggucuugacuccuaaccuuaggugaucugccugccucggccucucaaagugcugggauuacaggugugagccacggcgcccggccucuuuccuuagcuucuaaaaccacgaguguuuucaggagcccuucaguugggagcagcugcaucuaggaccucuaacuucuucaguguucucggguggcuuugcuggugucacaccugccacugccucuugacccucagagucucagaucugggcaccuguuccguugccucuggguguuaauuuuuggcuacugccauuaucuccaaaguccaucaggagaggagucccagaagguugucuccaaauguuucuuuguaaaauacuguuucucuccaguguuuuaaaauauuaaugauccuuugaaauuccagauauuuucccacuugucucacuagcuggucuggaucuuugacucagugcucuguugggaucucugaaaacgaaaugaucgauucaaacgcuucuccuugaagagcgcagcagcagcagcaucgggcgaggagcccuccagauuggaagugguuuuucugacucuuauuuugguuuuguuugcuuucugaaaguuguuacugaccugaaaguguagcgucgugaacuggggaaggagagaagagaggcaggaugagaaucguggagugcggaggcagguagcccguggggugccuccugugcucgguggagcuggaagccgcuuaggugccagagcuuuuucugugaccaaauucuggcuuuugaaauaacccaguaacaguucucuaucuuuucauucugcccgcuccucccacagccuggucccucagaggaaaggaaggacaaggagugcuuugcagcacgugccccuggcggcgucaugguacuuuccuggcccugcugccccugcccguccgucuuuuaugauuuuuauuuacucguauugguuuuuuuaaauuucuauuuuuugcagaacugagccuuuuucugcccugccuuucuccuguuugucuuuccuuugugguugauauuguguugucuucuccaaaguauuugucauuagaaacuuacagcaagcguauacuuuuuagcaugucaguauuuuuauuauguugcccuccuugucuuugauaacugccuguggacgcuguguaaacuuucugguaaaaauccuuuuuuuucccccuguagucucuccauuucaaggacuaaaacagucuugcguuaaguaaaaaccugugaccagagcugaaggaagacucuaggacugaaaacugcaacagaaauuagcacaauuugaaaacaaaacaaaauugcaaaagccuuaguugcuuuuuccaccuaagaaguugaucaauggagaaaauguccacuggaguuugaauaaugaacuuugaguuugggugcaagcaaaugacucagagaaggguccagcucucaagcugaaugacaaacaugcuguuguaaauuuagucucagguguaaauacccaagcccucugguacccagggagcuggcuggucuguggugcaugugugucccugugauggcaaucauuguaguugcuggccuucagaagaauugaggaucugauggagguuuuuuauguauuuauuuucuguucaccuugugacccugugucaaaauuuauaaagauacaaaaggcauuacugaaaugguacuuucuguaauuugauacuauuuggcuuaaucaucuucacuugacuauuuguaauacuguuguaauguuaacucuguuaaguacccaagcugcuugucuuccaccaaagagugcuuuauuaacaagaaucugugaaaaucacauuuaaacacuguugcauguuguaagaccaggugguaccuuaguaaccuaaaacuugcaagagaauauuaaugguagcuuuagaagacucaggaggagaaacugacuucagaguuggaagauguugcaagucguuccuuuuucuguccuucagggacugaagaacugggaggcugcccauuguuugguugccagucauacaaauuaaaaucauauuuccuuccaugaauggaagaaacacacuauugguuuuuccccuuggaaacagcaaucccaaauaaugucggcuuacaaaaaaaaaaaguuaccacuuuuuuagaguccuucccuguaacauuggauuuuuuuuuucccuuaugagauccaccuaaggccauugacguggccugcgaucucagugacaaugaucugcuucuggaucucacuguugccuuugguuagggaacacaacuaguaacucugcagagugccuucucccgcagcccuacuggaacacagcagagucugugccaugaagcaguuacagaaacagaauugaugugcugcuaaaaaaaaaaaaaaaaauggggcccgaaauaaaagaauauauaguacucaccucaguuccuuccauaagaagugggugguuuaaugauuguuaagccauuuuugccugugccgggagcauggagggcugagaugucgacaggcagugggaaacaaaugcccuccuaagccacaaggcgugcgccagauuaguaggcaacuccauuuuaagaagcugccuuuuucacaaaacuggaagaaauaaaagcgguuggaauaaacaaguuaaaagucuuuaaugcaaaaaguaauugaaaggcagugccuccauuuugguguacuuucuuggaagaaaguauaaaauugaccggcaucaugagagacggaagaugccguguucucagccaaacaagcaacucuuuccccgccaggcacugucggguggggucaggccagcuuuuaaacacuggggacuggaucacagaaaaacagugguuuucugucccuggaaaugaauaggcacaaagacccacuuggcugugggcagacuacucuucaauaagauuugggugggaggaggaacauuccuuuugcuauuuugagcugagacaauauaaauauucaaacugugccaugcauaaagcauugaauucucagggcaccucuucuuccccuuaccccuuuuaaggccauccccuccauuaauaauaauccagguaguugugaaaaucgugcuucuaucugaucccuucuuaguuuggcuuuucaucccaucagaacaaguaaacguaggcgccacagcucuugugaguacugucucccucacggugaaugagccuccugguguuucguccaagaaaagaaagggugucacuggaaccacagcccuuuuucauuuuauaaacugccucuucauguugccugcucaaguuuccaccuagaauugcuaucacuguggcucuuucuaaaaaucuuucuauuuaacugguucacugaaauuagucauagaaaacuugugauuuggugaagaggcauuccuuguaauaaccaaaugacuugggauggugugcauagcaagggcaguguuacacuuaugaggacugucucuagcauccaggaagucucugggucugagggauggaaaguucuuccugcuaugaaugagaguggacucuuccccucacccccaacugaaaccacaaacaaccagaaucuucuggaauucugacuuagagucguuguuauagaagaccuuguugcuauggaacaugaaacugugugucagauggagagauccccuuaaccuaagagccuuaaauagcccugaaaguacacugggacgguuugcgauggaauuaaaauuggaagugaauauuuuuaggugcucuugaagcuuucuggggacucaaaauuaucaaaagucagggacaguccggaggaagagcgucugcaaaacuggguuccuagaaguauagacggacuuagcuuuuuguagaauuuggugaggagcagcgccucgugagagcagaauggccuggcguggccagugcuucccggcagcacgcagcucugcggccuccagaauuccccuguucugagcuugaugccccuagccuguccccuaccuacuuccuccccuccucucuagcccucucacaggggugauugcuaccucucuguuuucuugggccuaggcaaguuuuagaggaguucccaagcauuguuaugaggccagugugcucgcugggcugggcgggauggccugggcuuguguguggccugagggcucuccuggggccuucucuuuucccagucaccuuuggagccacagaagcagugcacucauuggaugucuguucuuaacacagcuucucuuucuacauuaaaaaaaaucauuauugcauuuuggaaagcagugcucaucaaaagcaacuuuuaaaaccuauuuuauuguuccuuuaaauguucucucccgcugaaacugcccuggagaggcuaucugcugcucuuccauuuacccacaucagguuauucuccaugucacucaguggagaugacuccagauguguuuaaagacuggacaauucaccuauacuguguaggaaauuaccuccuuaauuaccugguagaauugucagcagacauguucauccgaugauaguacugcaguuuucuauuaauaauuugcagacuuuuaucuaaccugcacucauguacagauuauuaaaaguuuuaaaauguaacugaucaguauugaucaaucauugucuugauuuuuuuuuacagcguauauuucuaaucauauuuuuuaaagccaagagaacugguugaaugaauguuuauuuuccugaagguauuuuuaagauaaagcuuccuaauggcguguaaacuuugcauauguauguaguuugauacauauugucacauuugaaaaucuuguggguuguaacugguuuuauacaaaauaucgaauaguggaaauuguauaauuacaaucauguaauuaaaaguauuaacccaa

SEQ ID NO: 192434 - RNA, 9967 nt, Homo sapiens
cuucuaaagcccugaugcacccacccuuaaguggaagguaaugcuucugcugggggcugugcguucuuccacuccgucccaccuuugccguggacuaaacaggagccacugaacgagaguacccuggcucccggcccugcagauuuucaccaaaaacucuaggacuaaguuaaaguagggacugaaauaccacacagagcucgcuguaaaccacccgcucagcgcaguaagucgggauagucaguagaucugagcccuugagggaggcgccucccccuccuccgcgcagcccccgggcgcccggcccagcuucccgcagccaggguguauugagguaggcgcgcccagaccugagacggguugggacugggcugcgucacgcgcgggcucuaagcgcccggggccccgcccaguggccggcacagccaaucgcagcgcgggaaggcggugggggcggggaaggccgccuggaaacuuaaaucccgaggcgggcgaaccugcaccagaccgcggacgucuguaaucucagaggcuuguuugcugagggugccugcgcagcugcgacggcugcuggugagcgcccccgaccagaccgagggacagggcgaagggggacuggaggagggaaccccccuuuagggacacugagaggaggcgggcgcuucugggagugagagcuucugcccggagcucugccagccucgagguggggaacgggggagggcgguuggagaccccagggaggcgccggcaccacugggagggcccgggcggggcaggucagucauccugugggcugaagccggaccggaccgggcggcuucaugcccccagccuggccgcggagcccccgcucccugcaccgccgcaaacauucucggggcgcggcggcgcgugcagagggcgagagcaggcggugcggccccgguccuggcccgcccggagcuccgggagcugccugccucgguccgggcccuggcccuggggccccuggcuuccagcggcgcggccuugugacccugccccgguuuaggggagcgaguagcacagacccaagugugggacggcgggaauagugggugcucuccuucccagugucuccuggaaagggauucccgaaagguuuuauuccaaaaggagagguuggaagacauagcucaucuccugcuguguaucagccaagaaggugugaggugguguuccuuggggauccgcuugcaucuacuugggaugguacgucuucauuagugagguuuugccuggaugaccucaguacaauuggugcaaaaccuggaccaacucuuuccuaguuuucuaguuguugccuuaagcuucucacccgucagguaucuuucacacccuucucauacccuaaauuaucgcauaugcuguuucaacgccuccaacucugcaggcugcuuuuaauuuuggugggcccaucaaauaccuccacuuggccuguuucagccucuuccacaguccuuggggaaaugcuagggagaauaauugaaauauuucuauuccacgggggcuguaagauggcuuuuuaggauuggucuaaucagauacucauuucuuuucucuuucuagguuuugaaacaugaaucuuucgcucguccuggcugccuuuugcuugggaauagccuccgcuguuccaaaauuugaccaaaauuuggauacaaagugguaccaguggaaggcaacacacagaagauuauauggcgcgguugguaacaucugaaacuguccagagggacucuggagagaaugguccucgcuguugggaguugauagccagagaguagcuucuagacaccagaccuuaccaggcaauaaccuaacagcacccauuauaggugcaauaugggcauauaucuccauugugucuuggcuuggagaacagcucccagagaaguaucaacccaucccuggccaugguuucucuuccauuucugcccgcaaaucggcuuggugaacauggguuggguaaguagacauaaaguccaccagcuauauguuugccucuagaaugaagaaggauggaggagagcagugugggaaaagaauaugaaaaugauugaacugcacaauggggaauacagccaagggaaacauggcuucacaauggccaugaaugcuuuuggugacauggugaguguggcaaggauugcugaacucugugcugcuucucaguucuucaccaaaauagucuugcuuuuaacauuuuauuuacuucuccuugaagaccaaugaagaauucaggcagaugauggguugcuuucgaaaccagaaauucaggaaggggaaaguguuccgugagccucuguuucuugaucuucccaaaucuguggauuggagaaagaaaggcuacgugacgccagugaagaaucaggugagacagcgucagauucagacccugucuccacaggaaagccaagaaggaauuggugucauugcugugguagaugguggcacaacauauggugauggguuuuuuguauuuuugguuuuugguguuuuuuuuguuugcuuguuugagacggaguuuagcucuuguugcccaggcuggauugcaauggcgugaucucgucucacugcaaccucugccuccuggguucaagagauucuccugccuccaccucccgaguagcugggauugcaagugcucaccaccaugcccagcuaauuuuuguguauuuuuaguagcgacaggguuucaccauguuggccaggcggauuucaaacuccucuccucaagugaucugcccgccucggccucccaaaguguggcgauggguuuuuuuuuuuuuuaaagaauauuaagguaauucaauuaugggguacuguauuuguauuggucuuguaaauuuacagcuuuuuuuuucucccuuuuuagaaacagugugguucuuguugggcuuuuagugcgacuggugcucuugaaggacagauguuccggaaaacugggaaacuugucucacugagcgagcagaaucugguggacuguucgcguccucaaggcaaucagggcugcaaugguggcuucauggcuagggccuuccaguaugucaaggagaacggaggccuggacucugaggaauccuauccauauguagcagugguaaauggagcuccuuaucuugucauucgugcucugcuuuuggaaaguggaacacuuucagagauaacagauacuuuuuucagaauucacauuuuauaugguagaaucuacaucugcaaaccgugaguauugucauuauaaauuauuagccuuuggccaggcgugguggaucaccuguaaucccagcaguuugggaggccgagacaggcggaucacgaggucaggagaucaagacaauccuggcuaacacagugaaaccccgucucuacuaaaaauacaaaaaaauuagcccggccugguggcgggugcccguagucccagcuacucaggagacugaggcaggagaaugacgugaacccgggaggcggagcuugcagugagccaagaucgcaccacuacacuccagccugggccgcagagcgagacuccaucucaaaaaaaaaaaaaaauuauuagccuuugcacaguucucuggugagauggucaacagcuaaugguuaccauauaaguaccauuagaugguuaacacacagcuguucuugcuuuuacauaacauggagaauaagcaaaccauucuacauauaauagaacuuuauccauugugaaaaauuuuuuauggacagauugaccuagggguucucauugaagaaaugucaacuaauuuuucauuuucaaaucaacaaauagcauuuuauuucaugggacgauuuauaaggguguugauuuggaaauccuagguugcaaauugcugaguguuucgguucuagaacuaauguuccccaggagguagaugguagugaucaagucucucccccuuuaacuuuaaaaggaugaaaucuguaaguacagaccugagaauucuguugcuaaugacacuggcuucacaguggucgcaccuggaaaggagaaggcccugaugaaagcagucgcaacuguggggcccaucuccguugcuauggaugcaggccauucguccuuccaguucuacaaaucagguaagugucauuuuauuauagaaauuuaggcagaauugggaagcaucacugugauugauucuuggauaugacauccugcuuugcaggaauguaguauuuugagagugagcauuuaacauagugauguuugcauuugacaugagaaaauacuuaguuauguuaaacuucucauaaauauuuuuaaauggcuauguaauuguauagagacaaccuaauuuuccaaacuauuuuccaguuguugggccuuuuuuucucaaaguuuuuuacuacuguaauuaggacuguaaagaauccccuucaaguuuuuguuuguuuauuuuggugcuauuuuagacugacauccuaggaacagaaagggauuaugcgaguugguauuugggcucagagauaucuaaaucaccuuagcuguaaacaauagguuuuaucuuuuggauuuucauuuuuuuugguagaaaauaucuugaacuuaguugaaguuaguugauuucuagugaguugagguugacuuuuuuccuuuaucagccauuacuguuuuccggccaauauuguuuggguccuuauuuggcauuuguuuaugacauuuuacugaauuuagagaugccucccuuauggagggugguaggguggguuacugucacaugucgcuuggagcuucucaccccagcauuaauuuuacucucccaggcauuuauuuugaaccagacugcagcagcaaaaaccuggaucaugguguucuggugguuggcuacggcuuugaaggagcaaauucgaauaacagcaaguauuggcucgucaaaaacagguauaaaacucaaaauugaaaagggaauuuuuguuccaaaucaguauuuggauacaaguucacaaaagcucaauuucaaaauuccgaaagucuuucuucuacuuagagugaacacagaaauauuaauguuugauuauaagauuccguaccaagcuuuuuggaguuauugcuauguauuuguaauauuuuauuacuaaguuuugaaaauuuuuaaauucugaaacacauuaguccucaaggguuucagacaaaggacuguggaccuguagguuugagagcugauugcuuuuuucugucuaauuuuucaacaaggaauaguaagcagaaacaucugccucugcugguucuuuguuaagucugagagaucauccgggaguccaguggucugugugcauccuucuauugucauuggaugcccugucaucgaauuucacuccccagcucucaggcuuugaagguugucagaaucuauuuucucacaauuagcauucuuuaauugagaugugacauaagguaguauguggggacagacugcuacaguggaauuccaguucugccucaguaucuuaaauaguuaaggacccacaagaaucaauauauucauucauucauuuguuuauuuauuuuuugagacagagugucgcucugucacccaggcuggagugcaguggcacgaucucagcucacugcaaccucugccuccugaguucaagugauucuccugccucagccucccaaguagcugggacuacagggaugugcuaccauacccagcuaauuuuuuuuguauuuuuuaguagagacgggguuucaccauguaugccaggcugcugucgaacugaccucaugugauccgccugccuuggccucccaaagcacugguauuacagacaugagccaccgugcccagccaguuuuauuuuauucugagauggagucuugcucugucacucaggcaagagugcaguggugcaaucucggcucacugcagccuccaccucucggguucaagugauucuccugccucagccucccaaguagcugggacuauaggcaugcgccaccacgccuggccaauuuuuauggggguuuuuuuguuuguuuuuuucuuuugagauggaguuuugcucuucuugcccaggcugaagugcaguggugcaaucuuggcucacuggaaccucugccuccuggguucaaaugaugauucuccugccucagccucccaaguagcugggauuacaugcccgguuaauuuuuuuuuuuuuuuuuuuuaauuuaguagaggcaggguuucaccauguuggucaagcuggucucaaacuccugaaaccucaggugauccacccgccucagccucccaaagugcugggauuacaggcaugcaccgcaccuggccaauuuuuguauuuuuaauagagacgagguuucaccagauuggccaagcuggucucaaacuccugaccucaagugaucugcccaccucggccucccaaagugcugggauugcaggcgugagccacugugcccagccucaggacauuuauaaauggauauuaacagcauuuagaauagugccugacacaugggaagcacuguuuaaguauuagcuauuauuauuaauggagccaauuuucccuugauuccuuguauaaaauggaaaaccugcuccucuuucagcugggguccagaauggggcucgaauggcuauguaaaaauagccaaagacaagaacaaccacuguggaaucgccacagcagccagcuaccccaaugugugagcugauggauggugaggaggaaggacuuaaggacagcaugucuggggaaauuuuaucuugaaacugaccaaacgcuuauuguguaagauaaaccaguugaaucauugaggauccaaguugagauuuuaauucugugacauuuuuacaaggguaaaauguuaccacuacuuuaauuauuguuauacacagcuuuaugauaucaaagacucauugcuuaauucuaagacuuuugaauuuucauuuuuuaaaaagauguacaaaacaguuugaaauaaauuuuaauucguauauaaaggugggccuuuuuuuaaugcauuggcuuuuuguguagucaggaaauauaauuaagcucugaaauaauaacuucaugugccaaugguauguuaggagaaagaugcuagcagaaagcuggcuuccuggcucuugaguaguuauaaaaauacagacuuuauaucagcugcccaguuacuguguguuacccaacuccugaaucuaccaaaauuugauaaacaauuuggaaggacaaaccuacauuuuuuuuuuuuaugagacggagucucucucacucugucaccaaggcuggagugcaguagugugaucucagcucacugcaaccucugccucccggguuuaagcaauucucugccucagccucccgaguagcugggauuacaggcgcgugccaccacgccuaguguauuuuuaguagagagaggguuucaccaucuuggccaggcuggucuugaacucucgaccucgugauccaccugccucagccucccaaaguguugggauuacagaugugagccacugcgcccagccccuaaauuguuuuaguaaagaagaaagcaguugacuuuuuagaaaaggaaaugucuucuuccuuugacacauaaccucaagaugguuagguuacgugauaaaaagugaagcugcuuguuacuggagccucucugaauugcuggugaccacuuugcagucugaggaagacgcaggugcaaguaaguuaccaaggguauuuuguuuucauuccaagucucugaugacauauuccaccuagcucuucuagaaaagcuuauuuguuaacuaguguuagcaaaaauaaauggugugguuaacaaaucucaggcauuugacaguagcuggagaaauuuguucaagguccacaagagaugaggcugggcuacaaaaagaggccucuggccgaagauggauaagagaucacaagugaaaggucagaagucacuaggccagacucuggcuaccuaaucccugaauuaaaaauaaacucaaaauggggggaaaaaggcuaagcauauaguuacacagguaguaaauacaaauaaaacgauauuuuugcauauuuaaaauacuggaagaaaguacaccaaacuugugggugaauuaugggugguuauuuaacucguuuagugaaaagcauguauuuuuaugagcaggagaaaauaguaaagauauacccacauucugcaggcuaaaggagagcccuguguguguuuuaaaagcccauguuuccagucaaauaaaaaauuaccggggaugagcuggugaaauuuaaucgaaaggugauccauugugaaugcaaugggagggaaggggcaugugggacuguguaucccaaaaacccuuugauagccuauguccacagccaucucuggaaaauccagucuaccauauucagucuugaguuuucucugagaaaggauuccuucgucuuugcagcagcaggcuaaguugguacucuccacagauucuuggaacaacaacccaggcucuaaggaaacaucuaggcacuaaauugaaugaaagagugauggcuuuuuauucaaauaaaaaaauuucaaaucugucaaaacagcaccccucggaaaacuaaaauagagauauuucaagauuuuauaauuuucaaagaccuuugaaauauuuuaaacuugugaaaaguuacaaaccugauguguugucuaaaagcguuuuucaaacaagccaguagacuugaaaaaucuagucugaagcacagacuuaaccaauauuugcuggggauaugcccccaaaucuggccauaaacaaaaucucugcaguacugugacagguucaugauggccaugacgccaugcugaagguuuaccggaaugagagcaaggaacaccuggaccacccagggcgggaaaacggcuuaaaggcguuccuaaacuacaaacaauagcaugagcgaucugugccuuaaggacauguuccugcugcagauaacuagccagaccccaugccuuuguuucguuugggaaggaauacuuuuaguuaaucuauaaucuauagaaacaauguuuaucacuggcuugcugucaauaaacauggguaaaucucuguucggggcucucagcucugaaagcugugaguccccugauuucccacucugcaugcuauauuucugggugugugucuuuaauuucucuagcgccucuggguuagggucuccaugaccaagcuggucucggcaaauauuuccuauacucgaacaucuaaauuguuuguuuucuuacuugaauugcaaaggaaguaaggaagggugagauagaaaucacugagcauauuaagagggaggaguuugcugaugugggaguguaguuaugacacuugggcaucauacuagaggcuauggacuuagcaauaaggaaacauccacucagcccuaugugugguucauguguauguuuugccuaugaaaguugaaacuguuuucuaaauguuauuuccuuuuguaacugauaaaauuucuaaaaagcaaagaagaaacuuuucuguauuaaaaauaacaaacauuaguaaauguauauauacagucauguguugcuuaaugauggggauacauucugagaaaugugucuugggugauuucaucgugacgugaacaucauagaguacacugacacaaaccuagaugguauagccuauuacacaccuaggcuauaugguacagccuguugcuccuaagcuacgcaccugugcaacacaucacugugcugaguacuguacacaguuguaacacagugguaaguauucguguaucugaacagaaaaguacaguaaaaauauaggaucauaauuuuaugggaccacuaucauauaugcagucacugaccaaaacaucacacagcacaugacuuguguguauggauaucucaauuguaaacaauuucacaaauguucauuaucucuuuuuaaguaaguuaauaaguaaaacuauuacuaagcugcaa

SEQ ID NO: 192435 - RNA, 72608 nt, Homo sapiens
cuuugccguccggcuauuagccuacuguggcuagucacccccggggucccggccuucucgggcuggggccgccgccaccgcggcaggacggggaggcgggccauggcguccugcguggggagccggacccuaagcaaggaugaugugaacuacaaaaugcauuuccggaugaucaacgagcagcaaguggaggacaucaccauugacuucuucuaccggccgcauaccaucacccugcucagcuucaccaucgucagccucauguacuucgccuuuaccagguggggcggcccagccgagcggggggcgcguccaagggcuagggaagaggcgggagggaggguggcggggaggggggcccggcauggcucugggugaggaagugggcuggcugcuccacgcacacgcacuggcagcccgccgcccacgcggccccuccgcccgcccggugucucacaguacgcuagccugcuccccuaccccucagugccccuucuccauacagcgccuccgguuacacggggaacgcacgcgagucaccuagcacgaucgcccccucacccaccgcacucagcaucgcuccacacaacaucacgacgcgggccccuccucugcacugcuccagccuucgucccuacccagcacaccgcaugaaucaugucguaugcaccacuuucagcacacaccgcuacacauacaaagcaccccaauccacagcgccugcaggcaccauacacaggcccaggacacaaccuagaucccuuccuguggaacuccgguauucggcacuauccguaacgcacaaaaaaugcacaugugugcugcauacacggucuuuccugugcagcacuucccguaugcauugcacacaagucauccagcauaacacuucccccagccucaaacacuaccaucuguaccacggcacaaacugccacucuaaacacacaccucacagcggaccuuuccuuuccagcacagcccaauacccaucaucuguguacauggcugcacagacaccagcccgccacacaucacgcggugcauacccugcucacucauuaccuaacauacgugcugaaaugugaucuuguccagcaauuuuaauggugccugggguauaguaacugcuguguguuaaaugaaacacauaaaccucacacagcauaacacaacucucuuauucccuggaaaacauacacacacauucuaauauauaccgguucauaggagcugcccagcccaaaucuugaacacaccucauguuaacucuggcacugcgccuguggcuccucauuccuaaccuagagaacuaauucauccuugguucauaaggagguacacaccgugguuccuacuuagaaugauuuauacuuucugaaugaaccucuuuaaagaaagggaagucacaccucucucaccauuauggcuuaaaaggccaacuuagaguagaguaguuuuugagccacacuuuugguuucaaaacuggcuguguguccuuaauuaaguugcauaaccuugcucugagccucaggggccacacucguaaaauggggaugaaauaucuacuuauauaggguuaugaaaauuaaaugaaugugugugaaugcauuuagcagagucccuggagcacaauguacaauucaugucaguuacuucucucccaguauuuuuauccaacaaucaagguucucugucagggucagcagaacauguguagggauauauauauuggguagucacaaggauugagagaacuucuaguauuugggagggggagcaguuaacggauacuaaauguauugugacauaugugacagcgcuguacaacauaaagggaauugucuucuacacagucguuugcauacacacacacaagugccgguggugccucccuuaggaauaacugcaguuuuucaaauccucauaaaacuaauauccucccacaucacacuuguuccuuaccucugggauucauuugacucuugguucuuguuauguaaguguuuauccauuugaaagaaucuaccuaaagguauaaagcuuaaguaacaauugcuuacucuuuaaugauugagggaucuugccacuauuacuauaaaaucugcuaaagcugugcagcaggugaagaccagaccuuuccacaguaccugaccagacauauuucuagcuuuggagagaaaugaaucaugucccuaacuaugguuacuuucaaauacuucauuauguugccugauuuuaucacuuaauagcuguguggccacauaauuuugcuaggccucaguuuccuuaucuguauguaaaaugaaaauaucaauacauuaaucugucgggauuauuugucaugaggauuaaauucaucuuuuuagauaaucuguuuagcucagugcauggcaaguauuaagugcuuaauaaacauuagugguuauuacgaugugauuucauugaaugcuacugucuucuaauuuauauuuauuauugaacgaggauguaguaugcucuguaauugagaaggauaaaagcacuggaaaaauggacauuagauaacauacauaccuguuugauguuaacuucaguuuaacuucaucuuaggugugggcuugaaauaaugaaauuagugagggaguuucucuggaaauuagaaaaauaauuaugguauuuuguuuuaaauaaugagaagcaagaaugagccauuuguuucagccuuucauuuuuaauauuauucuagguccuuucaaaauagguuucucuuccucuuuucugauauaaaaagucacaaucuucugaaauuuccuuuuacaucauauucugucaaggcagucaauaaauugcagcagugaaaguauaagaaaugaauacgaauuuuaacagcuuguccaaaauaauagaagaaccauaaucugaacuucagacuguagucucauccaaaaauguuaacaauuuuauuucuuccacuaauuucauaaagagacagaaaucacauaaugaagaacuaauuaauaacaaguuucacuuuauauaaaaucauaagcaccauuaauagaauucguacuuacuaaaucuuacucauuuuuuguaaugauuugugacuuaaguggggcauuacaaugauagcucuauauuccuccauaaagacggaaaguaacgacuucuuaaaugaaaauguauccuauguucuuuuguaaugauuaacuccagugccuuauuauuuauuuuauaagauuuuaguuggacaauuguucagugcaauucuuucaguaaaacuuaaaagauaugucuuaaaguuuguuuugcaaagacuaguugucuaagagaacgaggagauaggauucuuuugggaugucauauaaccaguaugugagaaacaguacuuggguacugucacaugcuucagagauccagcaagaauuuaaaauuacagaggauuagauaccuugcacugaagucugagacaaguuuggauuugucaaguaguucuuuuguuagauggcccuuaggucaauucccuguuaaaccauaguauuuaaauaucuccugucuuuaucaccaucauuaaaaauaaaguuagauacuaccuaaucauuuuccuauuugaaaaagcucauuuccagccuggacaacaugguguaacccuaucucuacaaacaaacaaaacaaaacaaaacaaaacaaaacaaaacaaaaauuagcugggcgugguggcaugcaccuggaggcugaaguaagacgaucaccugagccuaggaggcagagguugcagugagcugaaucacgccaccauacuccagccuccacccuacucacucgacagaaugagacccugucucaaaagaaaaccaaaaacuuauuuucccacauuuuagaauaaguaggcugggugcaauggcuuacgccgguaauccuagcacuuugggaagccaaggugggaggauugcuugaggccaagaguccaagaccaaccuggcuaacauagcaagaccccaucucuauuaaaaaauaaauaguauuuuuauaaauaaaugcuuacgcauaugucuuagaaguuuguuagcaaaguagggcaaggaaaacuuuugucucaagcucagaguauaauaauuaccuauaagauacccucauauuuacucugcauucagggguugguaaacuuggaaauauugaaugccuuuaguuuaaaaaacucaagcuuuagauuuagaaaacaccagaaucuauuaauucacauucaaagaagcccaccucuccuuaagaggcaccugccauuaaacaguagaaucagccuuuguuagcacuuguccaacaaaaauuguuacuuaccuagaagacguugccuuucugcggauuuguguacuuaagugaucaucaauuugucuaugcuucauuucuccucgauuuagaacuaaggagacaggcaaggacagggaaauggacagacugauugauugacugauugauuuguuaauaaugguuuuuacuuaauuucccuuauuggcuuuggaacuccaguucaccgucauaucauuggggcauacuuguggccaccuguauuauauugcuuauggauacuugcuagcauucccuguucuuucccucuugaccacauaaauucccauuagaaaauguccccugauacugcugauucaguugucuuuauccuguuuccuuuauauacaucauguuccuucucucccagcaacaaaagcccugcaugcccuuguuggcugacacuagcaauguuaaaugcucaucuauagugauuaugggcuaggauuaaaccagcccuggaggugaacauuguguuagguugcaccugagguccaguuaucaaugauuguuaacauuucuuuucccugguuaccauuugaaucaaauuuuuuauugaacuuaauguuuuacauuuuuucuuauacugauuuccagaguuuuauguccauaauacgauuucuaauuuguuaaagggggaaaugugccauauauuucucuggggucuacugcagugaaugggcacuugggugacuuaaauauuuauuuggcuuagaugaugccucagcccacagagauuauauaccuaggaacugcugccuuucagacuccucuuuaguaagcaaccuuaauucaaguucaucuguucugaauaaacuguguuuagcauuuuagauguaguucuauuaccagauguaacacaauuuaucuugugacauaauuccuauugccccagauuucuguagagaaguuacaguuuuucagucuuaacuaaucccagaacgaggacuaguccggucagccugcacugcuuccucagcccuggcaucccauuuaauucaauuaauucaauucaacaguucauaguccucauugccucuagcccagguuucucccaaccuggaguucaccaucucauuuaucuucagcaggucugauugggccuuuauagcuuucgggacuguucucuuuccguucccaagccuuugcucagcaaacucccaacccuuugggauagcugacucucaggcccuggcuuccccucccuccagugcugccccugugaucuuuuuagacaaaaucauggucccaucuuucccuguuuaaaauucucguuuaucuaauaaauacuuuaaaacauaucaccuuucuccugcuuuacuugauaacuuagcuguaauucuucacaaggauugugacuuuccauaaaacgaaauuaguaugguaugaaagauaacaccaaagcugguugacaucgguauuucaguagaugccugucaccuauaggaaaguacuagcuggacuccagcguccuuuguaauggaguaagucuacuuucccaccucuaucccucccuccauacacagcacacccaacacccaacacccagcaggccccggcagcucacgugucccauaccuaggcagggcugccaucucucagacuggaaggcaccucccgccaccuccugcccacacaugacaccacccuuggcauccuucacaauccauuuggaugguucccuuccaagauaccuuucucaauuguuccaagaagcacagaggaagaaauguuuauauccuuccaaauacuuguuauuauuguaucuaacaugucauaauauuaguuucuguaucagcuucuugaggccaguuaucugagucaucccaggauagacauccaguaaaugcugaaugaauggaaugcaugaaaucauuuauucaauaagaacuuaaaauuuaucaccauucuuuuccuuuaguugaugucucacccauaauucuuaacaaggaucauaacuuucuauaaaauagaugaaugugguauuaaagauaauaccuaagcuacuuaacauuggucuaccauguaaccugggauuaaacuuuuuauugggagagaugauccuuaaacagugacucaucuaaacaugaaccuauaggucuuuauuuaaggacucauauuaaaaguaaugagggagaagaugggagggggagagggacaauuaaccuagaagccuuaggaaucauaauaaagguuagauauuccuggcugccugaccccagggagaaagacuugucuaaaagauuguaggcaagugaauggacuuugcuuugguuuccugaaguuaccaccccucuggucaaauuccuguacucaaauauuaaauugagacagaaucggagucagaguccagaaauucuuuggagugcaaacuuuuuuuuuuuuuuuuuuuaaacucagggcuuuccugauacuuccugcuguuaagacuuugucucuuuggguaguucccuauccuagcugaaacaaugcucugcagaagaagccaagguguuugaaaacuugauugggauuuuagauauuugcugauggucucaauagcccucuguagccaacacucugcaaggggagagggaagucgcugccaguggacccugugggucaggcugagacuccccccucacguuaccugagucacuggccuacucugucauaucaucuugcucauucuugccaccuacuauggcagguggaugccugcugugugucagggcauugugccaggcacuagagcuaccuuggggaaaugaggugggacuugugcccuggggagcuuucuuauuuuaaucuguacauuugguauuuucacaauauguggucagugcuaugcuggagcaccuccuaaguuuagcagagagcgaggaagacuuugccucccuaagcuugucuguuuguguccuuauuggagaaugcauaauagcaaucuugaccuacagccagcauuccagaagcccucauaccuacuuccacucugccucuauuugugugugacugugggcaagauaaaccaagagcuuaauuuuccucauccuucaaacaaagauaauauuggcucugccuucccccacagaacuguggaacuguuaaauaaaacaccagcugugaaaguucuuuggaguguucagggcacugcagacuggggcauuuuguuguuaguagcugcaguagacccaggaaagaagucaaggcggugucacagcaucacaauggaaagcuuuaagucuucauauuuguuguugcugugaacaagcaacaugucuuaguugagcaaguacccuuaggccaggaagagucaagaugaggauugggcagcccagaccacaagucaugaucuuuccugagaagcaggaaccacacugcagccucacaaagccguaggagacaauuacaaucccaccaaggggccaaucacaggugaauacccaggcuuuuuugagguuugucagagacaguuccuacauaugaaaaacauuuccuucagggcaaggcuauacuaagauaaugucucauuguccuuuuuuaucuugauccacucaagaauaagggccaugucucuuuaucucagaccucaaagagucccuacccaaugauaggcauuaacuagaagaaggaaugaguggacguaaaugaagggcauucaaacguugugaacucaugauaguaacggacacuuucucugugccaggcacuguuuuaagugcuuuacauguuuuaaguuauuuaauccucacacaacccuaugagguagaacuauuaccauccucuguuuacugaggaggaaacuggggcacugagagguuaaguaaucugcccaaggucacacaggcugguggucuggccccagccuguaccagucacugcacuguauggucuccuguaggggaaauagcuuguacuuuggggccagacccuaucaguaaaaugcagauuaugaucauuuccugcuauagaguguuacaaagauucagagagcuaacaugcaaagccacuagaauauaguggcuguccauggauacuagaucuugucccucauuugggguccacucauguggacucugcagccaaguucuauuucaugauuaacuauggaaacuucagcaugugguuaaaucucuggauuauucgggguucagagaggagggacucacaccagaccuuauagaauggcccugugugcucagguugcccuguggccagaggggaguuuggcauccucaccugucaggcauucuguucuuuuugugcaccaccaccacagacugguaaggggcuguucuaaaugagguggggacacccucucugcucucgaaacucacaguagagugugacauuggggccuuuagucugauaggacucacauggcuucguaaacucacucuccuauccccuaaucuuugauugcagaaguuugaucuucccauacugcauauuuucaguuuauccaaagaccucacugucuuucauuaauacauuuuuuccuaauuagacaaauauaaaacugccaacuuuucagaaccaccugcuauuuuauuccguuuaaucaacauuuucccaccucugaaacuaggccauccauuugauccucuuuuucuaauaaaauugcucaaaauuuacaaaacugccauuucauugguuuuacaaccuaauauauuacccauuuaguuauaaauuuagugcugauguaccuuuucaagcauuuugauugguagauaauuuuaaauagagacuaauuuacugauuugccauggccauuuauuugugguuaauaacccauuaauuaaaauuuuaguuaauguuuuuaaagagaaugauguauucacgucgcuugaaguccaagauacaucaaaggguauguggugaauaccucucuccauacuucuccccagccccucauuuuuccucuuuggagaaaaccagugucaccauuuuuuuggguggauuuccagugacauccugugcaagcauaagcauaaauuauaagcuacauacccauacacauuccccaccuuguuuugcacaaauaguugcuuauuauaccuacuauucugcaauuugcuuuauuuacuuaaugauaucuuuuaaauuauuaugaaucaguugauucuuaaaaagcuuccuuguuuuuuuaaauggcugcccagcuucccaucacaagacuggaccauaauuucuuuacucggucucuuuuugguggacauuuagauugcuuccaacuuuuuaagaauacauguaaugccaugugaacaaucugggauauaugucauuuuugcaugaaugagaguuuaucuaaaggauaaauacccgaaaguaaaauugcugagucacagagcauaugcauuuguagacuuaaaauaaugccaaauugcccuccauaaaggugauuuauuuauacugcuaccagcaauguaugagcaugccuauuuuccuguuucuucauauccuccccagcucagucauuaaaguuuuaccuuuaucaauaagguagauuuuaaaaacaguuucuauuuuaacuuaccaugagugaggcugaccaucuuuucacuucugagagccuuagauuuuuuacucugugaacaaacccuucauauccuuugcccguuuuucaauaagguagacuuuuaaaacggucacuauuuuuaacuuaccaugagugagguugaccaucuuuucacuucugagagccuuagauuuuuuacucucugaacaaacucuucauaugcuuugcccauuuuucuauuuagauuuuuuuacuuugugaacaaacuucauaucuuuugcccguuuuucuauuuguuuuucuguguuaauuuguucuuccuguuaguugauuuuggggaaaaugcuuugcauauuaaggaaauuagucuucugucuugauaugaguuauaaauuuuuuucccccaaguuuaccucuuuuccuucgauuuuguuacugauuucuuugccaugugaauuuaccacuucaugauuguugauuguuuuguuuuguuuugagguucauuuauuuuuuuaauucuccaauuucuuccaguauuuuuuaaaauuuuuugaaucuuuaauuuuaauuuuuugaaucuuccagaauauauuuauuauaaaguaugaguuacagaaugaaccuucuuuucccaugcaacaguuguuaauuucagcuuugcuuuuauuuuguaaccuacauauuguguguccugucaaugucuuuuauaccaacccugugccucuaacauaagucaggcugauuuaggaugacagaucauuuuuucaugagauagcuuggcuugggggaacaaucauugucuucagugucuagcagaccugguuuugaaugccagcuuagcaaugucuuaccuacacaaccucagacaaguuacuuaaucuuucugaacuuuugcaaccucauuuuguaaaaugugguugauaauacuuccauuucgcaaacuugugaucauuagggauaauguuuauaaacugccuggucagugccuggcacacaguagauagauaaaugggagcuauuaauguugucaucaucauucccgaugucaauuaugugaugucagucugaaugaggacauugugugcccucagugugcagccauucuuaaguaaaaacugguguuccuggaaauuggauguugagccucccuaccuaagccagaaggcaucacagguacccuaguaaagaucaggcuggcauuuugagggccacauuuauaaccucugggcagauauucaguuguuaggugucuauuaaaagugcacuucacuggaagguaaagugugucugauuauauagucugguuuuauaaucaggucugugaaauuaacagucagcauuaguuuguuagugccguuuggacacauaaugaucuaagaauuauuguaugaucuguauaaaucucuuauuucagaaccuauguucaauccugucauacaucuggcagucccccaguuuuuagaacauggaaaucuuccuuccucuagguuuucuauuuggaucugaaaguaaaugcucaauguuguuuuucuauuuucagggaugacucuguuccagaagacaacaucuggagaggcauccucucuguuauuuucuucuuucuuaucaucaguguguuagcuuuccccaaugguaaguaaugucaugcauuaccacauuucuccuauauugugccuuucugguuuuuuugagaugugagucaucuagaagaugaaguaaagaaauaaucugaguuuuguguagugguuaggggcacaggcucuggaggcagacugcccauucugccacuuccuagccccagagaagccuccuaagagugcugagaauacuucaguuuccuucuauaaaauggagagagcagacagguacgguugugaggguuaacuaaaugggugcacguuaaacacuaugaacaugacugacaaauuauaagcucucaauaaaugugguuguuuuuguugcuguuuuuguuauuaucaguugagucauaaaauacuccauuacugcugaguucuuccuuuuugcuaaggacagggucaaugcuguaaugaguauuacuuaaauaaguugucccaagugaucuuuuaucaccauaaacuuugcugauuaugcauuuaggauaugaauuuucaucagcaggaaaaaaagacaaugauuucugugaauuuuacccccaucaugauuauggagugagugaggcaaagcuuuuguuuaaaaaguaaguuugguguucugccaugcucauaauucaucccuuuccuccaaauucuuccuuaaaaguuguuuucuuuucucuuauucccuuucaguaccuuuccacuagaauauucucuacuuguucgccguagccguagccacuucuaaacgcucacucuugucuucuauuuuuuuuuuuuuuaacaccuaugacauuuggaaauuguuccagucuuucuuagggguuauucuccaugggccggacguacucggguuuuaaauaucaugcuuuaagaugcauuucuuuuguaaccgcucaugcuauucaguaggcuaucauguguaauauaagaagcucauuaugaauguuaucagaugcuaccuggaaauguuccaugucaaggccuucaggcuuccuaagaugguggcaguggaauuuuguccuauuuuuugagauacgagucaucuagaagauagaguagaaaaaacagccgggugcggcggcucaugccuguaaucccagcacuuugggaagccgaggugggcggaucagcugaggucaggaguucgagaccagcgugaccaacauggagaaaccccgucucuacuaaaaauacaaaauuagccaggcgugguggugcgugccuguaaucccagcuacucgcgaagcugaggcaggagaaucguuugaacccgggaggcggagguugcggugagccaagaucacgccauuguacuccagccugggaacaagagugaaacuccaucucaaaauaauaauaauaauaauaauccaaguuuuccaucguaguuaggagcgucacucuggaggcagacucauacguagcacugcguuuacaagaacguagugguuuuaguauguagcagacuagcauaauaaucaugcugauaaaaccaugacucugaaucucucagagaaugaauuguucuacauagccaaguuauuugggagcugaguuuagcucuccaaccacucaagcuuuuaggugaaaaagaauuuuuuaaugaaaaucugcauaccuuaugcagauaugucaaauguaguuuggcuuuuccauagggauugaugguucugguagugcacaauuaucacgguaugaagacaaguugugcauaauauggguaagucauggaauaaagggguguugacccugcuauugaauuuuuaauuaaaaaaaaaaauuuuagagauggagucuugcuguguuacccaggcuggagugcaauagcuauucacaagugugguuauagggcacuacauccucaaacuccugggcucaggcaauccuuccgccucagccuccugagcagcugggacugcagggauacaucaccacacccagcuaauuuuuuauauuuuuuguagauagagauggggucucacuauguugcccagacuggucuuaaacucuuggcaucaggcaauccuccauccucagcugccugagcagcugggauuccugcuaucaaauuuacugaaaaaaaucccugacgucaaacagcuuuuuggcuauuugccaacuuucccuucccucucauugaauuuuacguuagaggagugcuugggucuuauguagacccuccucuccuucaagagugccguauuguauaugauauggcauaaguggccagccaaggguggguucccugagcucuuucuguacaaagguggccuaagaauacaucucaaagcaaggaaauggcaaacucuaucucagguuacauaccaacgcaaggcugaccaccaccaaagcagacauuuggagccucuaaaacaugacuaggugacuauucagaugguagugacaguuuauuccccauuccccucagccauucuaccuucuguaucccgugaucugcugccuucuucuuugucaucacucaaugccaugaccauuauuggucugugcccucuauuccuacuuuucucuuauuucucuuauguccucuguccuuuuuguucccuuaucagucaaucagagcaugauacgugcauauguccucaggaaacugaucagugcacagguaucaggucuguucuuuaagucuucagcuuuccuugaccuguguuauuuguugcuuaguucucaaggguuacuuuuucguggcuuugaaaguuucuuuuuggcuccuuaugaaaaauuugcuguuucugagcccagagcuguuuuagaagugugaggauucuaaaagauuagucucucaauaguugugauuuguacaggcgucccuucucuaagucuuuagcgggagcugaguauuggggcuucauuagcugauguuuuucuugagguaccaaaggcacugaagguuaggggauuaaaucuauuugauguaacacuuugugugauuucuucuggcuuugccucuguuccccaaugaaguccucuaaucuucaaaguugacuucagcugcucaaucucucauugugggacugugcuuuuguuuugauucuggaaagauaaaacugaagcucgguuuccuuauccuggcugcauggacuuugugauacgcacaaagggaggaggagccacagagcucaucuaguucagccagcucaguuuaccagugagaaggcugaaacgugccaccaugucccccagccuuugaugucagccuguucgcagggccacagcugugcauuucccuuccgcggugcugcucuggucauaucucauauuagguccauugcaaggugcuuuaucucuggcuuucuccauaauauguuuucugucuccugcuguuucucuuuuuuucugucagucucuggcuugucuuuucccccauggugggaucuuaguuggccuggaccuagcgugcuuugcaucccacaaaggagguggguggugacugaguugaugcuccucuguugcucauguguugucugugacuggcaggaacugacacauugaucugagccuuccuacugucuccuguuuccacucuauuucugcccuaccauccuuucuucuccucccgggcacauacacgcgcgcacgcgcgcgcacacacacacacacacacacacacacacacaccaccauucaccaaaaggcagaccaugccaaaaauaagguuucagauagguauagaagguauaaacaaggaggauggcaguucaguguccugugcaggagggauugggacauuagucagcaaagggaggacuuggauucucuucaagccauguauauauagcaaacauacuguguuuacgucguuuguuuucuaaagaucuguuuauucauaccuuaccuaagaguaguaaaacuaacuuuuccacaugaaagaauguuauugaauauuuucaaauuagggauggcuuuggaaggugcuaguggagaugguggggaguugggagggcccugggcagggugccccugaggugcguggccuccccuauuagagcccucucucaggccacaggccuccccaggagcccaugcugaacggcugucucugugaguggaguguacaugccccuucacacucagucuuguccucuuauuuuccauucuccccacccuuggcacauauucucaagucaaguagugaaaaugaauaggaaaaauggagcccaaacuugcccucuccuucacagacaguuuuggggaagugccugcaguggauagcauguccggaaaaauuuucuggcaacuugaaaugcauuuauccuugaccuguuaaaugcugcccugcacggcuguguauaggccaaaaguggauuguguccauuugucucaucacguaugugugaguucauguauguuaucuauguaguagacuuggucaacuucuacaggaagggagccuugugauucuuuuuguagagucuaaauaacaaaaaagaccuuugacuuucuccauaggauuuuauaauagucaggaugcuuuugacugcaagugauagaaaacgcauuucaaaauggcuuaaacacuaaggaaauucguuauuuucuuacguaacaagacguucugagauagggugguuggcagacuggcuuauucagcggcucagugaccugugaagacccagcuucuuuaccccuuucuguucugccgucuucuaggcugcagucugcccugcuggccuugagacagcuccugcagugccagccauguaguggcaggcaauggccagcagaugaagagaucaucucuucucuugugucuuuacuugaguagagaccccuuuucuagcaauccuccagcacacuuacaugucuuugacuaggauugggccacaugucucuucucaaccaguuccaaggacagaaauuuauaguguuuagaggaguagguguucaacagauauuuguuggcuagaagaaugacaggggacuaggauuaccucugcugguuuagaauccaccccugagcuauauggcagaggaguggacacucaaacaaaauuuugugugacaaucaacagggugagugguaggauuaggucccagaguucuuucauucagucccauaagcagauguggagggagagggcuggcagugagagcaggggaaggagagggucugaugucugcauuuacacuucucuccugcccucuucgccucuucaguucuccucuucauucucuuuuggcuuccuuacaaaaauguuuuaauggcuaccuucaucccauuauagcaacugacacucaaguguauguguaauuuuaacuauaccacccuaucacuggagugaaauuuagaaaccuauuugagucuccaguuggcuggagauuucuuucaacggucgaccuucugguguacauuuccugcuucugagaacucccuuuaacuguuguucauccccuuuccaccuuaccacgcccccaaaaccagcccagccuuaucuguacuucaagugccuggcccauuauuaacuucucaugaauauaugcugaauuaaauaauaaauccaccuggaaaaaaguucacagaacaagaccucuuuuuucccuuuuguugucugcaagagaaacaccauucagccccccuuuuuuuuuuuuuuuuuuugagacagagucucacucugcccaggcuggagugcaguagcacaaucuuggcucacugcacccuccaccucccgggcucaagcgauucuugugccucagccugcugaguagcugggauuacaggugcaugccaccacgcccagcuaauuuuuuuuuuuuuuuguauuuuuaguagagacaggauuucacuaugcuggccaggcuggucuggaacuccugaccucaggugaucugccugccucggccucccaaaguguugggauuacaggcaugagccagcacaccuggcugcacucagcacuuuuuuacggucuuugaggagagugaaaaacuaguauuucuuauuuuuccugaguuuaucauuguuucuucuucugugucauuugacuucucuuugcuaagauaaugauaaucaugucuccuugauguuuagaagugguccaaaaggucaccaucuucuaaauuuaaaaaaaaaaaaaaaguuccuuucuccuuccauccuguguccccuccuucacuacuuuuuguaaaaaaaaaaaauuuuccagcccagcguaguggcucacgccuguaaucccagcacuuugggaggccaagguggguggaucacuugaggucaggaguucaagaccagcuuggcuaacauggugaaaccuugucucuacugaaaauacaaaaauuagccaggugggguggcacaugccuguaaucccagcuacucaggaggcugaggcaggagaauugcaugaacccgggaggcggagguuguagugagccgagauugcgccacugcacuacagcuuaggcaacagagcaauacuccaucucaaauaaauaaauaaauaaauaaauaaauaaauaaauuuucuuuuccuuagguuugaaaguugccuagagaucauuuuuuucaccuucucaaauuuuccuagaagaacucuaacuaauaauaaucaaaaagagaagcugacuaagagggucugccagggagccucuggccugaggauacaaauguuagcuguuggacaggcaaugucugauuuuuauuaaaauacuuuuauuucccuaaggugaaguccugugaacuuaauuuuuucuagguauaacaguuucuggugagucaggcaaugaucuuauuuucuaauuucugacguagauuuuaaaaugcuagcucuucucaugaagacauugguuucuaguucuuuugaaauuaaucuugcucuuaauauaagauugaaaaugauguauucuaggccaggcacgguggcugacaccuguaaucucagcacuuugggaggcggaggugggcggaucacucgaggucaggaguuugagaccagccucgccaacauggugaaacccugucucuacuaaaaauacaagaauuagcugggcgugguggcacaugccuguaaucccagcuacuaggguggcugaggcaggagaaucacuugaaucugggauacaaagccugcagugagcugagauugaagccugcagugagcugagauugaagccugcagugagcugagaucgcgccagugcacuccagccuaggugacagggugagacucgucucaaaaaaacaaaaaagaaaaauaaaaugauguauucuagguggaaggaacgguaaauaaaacacauaguuuuuaaaugucccucauaagaaaaccaaaacccagcguucguugcugcaccacugcccuaagaagucuuccccaauucuccaacauaagcaagagaguaaguaaccaaaccacagauccaaauucucccaggcagcuuuuaucaaauccgauauaaagcacagguaaggaguaggaacuccuguggaaagcaaccaugaggcugagcccuucuaauaaccucagaaccauaacaauggucagagaagaaaaggaagccugccuuuacaagaccacugagaaaguagucaauagucuguugggaaauaagaucuguggggaaggcauugagaugacaugaauguucacaggaugcuacagauggggcucaugccgggcaggugaugcuguggaaugcggggcuccuccucaguugcauccccaccccuggcacauacacccuuaggcucugcaaaggugacuugacuggaguagccaggugcaaguaaccuagugagcguaaguaucaggacuuauaaucuagaacaugccagccucauccucgauuuuuuuuaaaaaaguaaaaugauacuuuuagcaauacugcugucugacaguaaagauugcacuguuaguauauaaugcuacuaaaauguacuuuuuaaaauaccacuuuaaaaaauucagaguuucuucucaggaggcaaugggcaguuaugacaaggcucacacucgcagggcggcagauuugaugguugaaaucaaaccuagacuggguuuugaaguuaguuacugaaagggucaccuuacauuccagggccuuaucucaccuuuuguaggcaaaaguuaccagugguucccaccucccuggauuaggguggucccuggcuuuuaucucuagagcuaucaguucccugcccuuucccuggucuugcuuuuccugagccuacuuaucaguuccacauuaugguaaagccugcgccaugccuuucccccuguugcaucggcucuaaacacuccuagcuuguuucuuuccccucacucuccugguucugaaaccaguccgcgcucaacccucagauaccgucucuaacccuuuccucuuccugagcugacccaguucugugaaaguucauaggaaaguccccaggugcuccucaugacucagccuggugacacaggaggcucugauggaacuaaggaggacuccaugagcugcaugaccccgggcagguuccucugccucaguacccuuaucuguaaagugggaguaaugaugacaccuuugucacugaguccuuaugacacugugugggggugucucauuccacagccuggugcauaguaagugcucaggaagguacugcugacuccugucguuaugauugcucuugagaauaacauuauagaauuuuuaagugcugauuuugucacaagccaaauaauaggucauacaguuuuagaggugaaccuuauaagaggaaacuauacagaaaacugacgucccauuuuauaucuaaaagguuaauuuaguguuauagauaaaguaauauuuacaagccaggcagccaccaaaauacagaagucacuuauggugacaagucaagagcuaucgccuaccaugaguaaagaggagcauuuggaagugaaaauaacuuaaaagaugauaauuuuagccaugaguuucccaaugacuugacaaaaggugauggugucacauuaccuggcgggggauccugguuuauaaccuucacugugacuuucugagaaagaagcagcugauuuugaaaaggaauauagguaguccucacugucugagcccucacuauuagaacucagaaaucaaacagauuuagaugaauuuucaauaaaccccuaaccaucugaguucucacuaccugccauccaaaacgcaggaaccaaacgcaaaugcauuuggauaaagcagagucucucaugaaccaaacucaccauccgaacugccaccuaggcacugauagauuugaauggugggggguacuuguaacugauuuucauaauaagaacuugacuuaucaaaagaaaguaguuaaaauauauuucaauguggucuuuuuaagaauauauagaugauuuuagaaugaauucaggaauaaaaauugcagcagaauguuugccucagauaggauucaagauugcaagcaacagaagcugacugugcuuauuaaagagccuguuaaagacuaggaguggcucacagugucauaggcuugcuuggaaaccaaccauagucugagcuuccagaaacaggcaccacccacagagcuguucuaaggaggaaaccaaccauauucugagcuuccagaaacaggcaccacccacagagcuguucuaaggaggaaaccccagcaagcaugggcuauggucugccccagugucacuucugcaauggauucuaagggagugccacuuuggauggccaccaccugccuacugccccuacuggccagggcuagagaaacagagagagaggagagcuguaccuacucccuuuacugucacuagcuccugaggccaagccuggcaugauugucacugcaaaaugagcccuaccuguaaagaaggcugggaaacaagcucuggugucucuccuggggacaugggauucauaaaguuggaaauuccgcaaguguaggaaggcuguucaaaaggcguggguagaccugcauagaacagguacucaccagaauggugcuuuuccauagcugugagguguaaggucaaggcucagcuugcuuucuucucccucuucugcuuuuuuaaugaaaaaagagaaaguauuggccuaucacuugucuuaagggaaaguuuuguccuaugagacuuuuguuucaguuguguggaaucugcaugugucugaacuggauugccaugucagagguguuuugucagcacaggucauaaugaaaagccacaugauguuucuguuuccucuguuauuuuucagucucucucucucucucucacacacacacacacacacccacacaugugcacacacguacacacacgcaugcacccacaugcaaacgcacacacaugaugaugacugugcuguccagagccucuuucccuggagcuccugggcagcugggacauuuuacuuguuaagguacaauaugcaucacacacacuuaagccuagccugaugacccacucacuauuacaacauuguuuccaugggaaauuauguucugacuucucaagacaaagcuuuauaaaaaaucucuguuguggagaguggugccugugaugauuguggugacagucguuauaauguggagaaaacauuucaaccaaacuuugaccucaaaguguuuauguagaaaaaaaaaaaaaacuuuuaacaguagagagcuuuuucuucuuguuaucuguauggagaucagcagcaccuuaaguuuuagccuucucugaaaccaguuccuucuaacuuuauaauguuauuuaucugcagguccguucacucgaccucauccagccuuauggcgaaugguuuuuggugaguuuauauuagcaauguaaaaggauguucuauuuuuuuaaucuuuuuucugcuuaucacuuuaagacuuuuacuugcuacucucaauaguuaaaacuuuauucuagcuuuuugcuuuuugauguuccuaauauacauguuuucuuaaaauuauuugacacaaaauaaaguguugaggaugacuuaaauucucuuacacaugaacuguuucaacuccacaugccuccuuauguuguugucucuuaauguacacaggauuugacuuaagcaaauaucucuuguuuuccuuuauguguuuucauagugcuuuuuacuagugcaagcccaagaacuuaugaugagcacauuugucuugugagcaucuggaagggaaugaaaacaaagcaauucaauuucuucaguuuuaugaaugagaaagaacuuggaaagagaaagacuucugacaaagaacccuaauuugaacuaaggguuagaaauaagcauauaaauauuggaugucuuauuuuuacuuaauuuuguagucuaaauagugaaaucaccuaaaggauuuaaaaugaaucuucaaaacuuuggauauuggcuucaucugaccuaaauaagucaccaaauuauuuuagguuuggaaaauguaaucuuauguaaaaauguacaagaacucuaagaaauugcuauuuugcuauaggcugccuauuuuucuuucagccuucagagcuucuagguaacucuuagucucuuugaauugauuggugaacuuuucacucagcagccauucacugagugagcugugugacagaugcugcucugugcccugaggccaccagggaaggccagacagacaggagccugcccucaaggagcugcccuuccacuuggagacaaaggacagcuaguaaacaaacuauuacacaaaucaguaaucaaaaaaauaucagcuaucuggaguuaguaggaagcuaguuaagaccaagggaggugacaggagcuggugucugguuuagcuugaggagugaugggaggccugagggagugaugccaagucugaaacugucauacaaagaaggauccaagccugcaaagauucugggggaggggagcaucccaggcaagaggaaaagcugccaaaauggcccacagcuagaaaccacuuccaggccaguguggccccaguauagugcacccugggagaagaguaggagagaagucagagagucaucgggcacagauguaaucauggggacugugggccaggguaaagagcagggcaugaagggcagggggaaaucaugggaggguuuuuccuagagugaccugauuccauuuacauuuucaaaaagauaguccuggcuauaacgugcauaccucccauugauucaauagugcuguuugaaguuauaaguuauuuucagcuauuuggacacaucugaauucuuccuauuucaaaugaucuaugguagguaguaagcaguuuuauuuccuucuugagagccuuugggagcauggagcccuuugauaauccgaugagaccuauagauagacccauucccuaugugugcauccauggacauugaccaugcacagcucugcauauaguguccagggcuucacagaccucgaagcccaaccaagaacuccagauugagaaucccugcaccacagauucuuucuguccuaauguaauuauucaagaggaucauaauuauuaaaaaguguaguggggggcguuuguggugaaaauugguaaaaaauggguggugcauaagugcaaacugaaggcaauucucauaucaacuugccuaaaaaaugugcauucccugggcccuaggaugcacaauuaugggcuggccacauaccacccgggccucccuugaacucccugaggccaggagaggggugccuguuagaaggucuggcacuauagcgcuugcaguggauuucauuccagccacggacgugcucuccucuggaguggcucacuggagauuagugcugagccaaguuuggauggaugcugugauccaaggucauuuguaucacggucucuaaaugucccgcauaaacauucuaauuccaaugaguucaagggaaagagaaaccacaaaaccccucgugaucguuucugaaaucucucuaaaacguauuggacaggguuuugccuucuaaaagugcauuguuaacauuucuuuuuaaaaugacacauagugauuauuaggauagcaauuaugagaugauagaacaauaaaauaaugccuacacgggguaauguggaguguaagucucaaaaaaguggcccugggccaccucuugaaccuuacacugguaguacuguccacacccagccuugcccuccuccaguccacuuaguuggcuuuuuaaaauguuaccuagaucaucuuauuuccccacuuaacuuacaaucauaucugaaauguuggccguggccuuuaagcccugauggucacuucagggccgccuugcuccauuccccucucugccagugcucuagccacauacgggguccuagauauuucucuuuucggaaaccgaccugcaugcuguucucuaccugaauguugcgugcaauccucacacccaccccgcacacccuuugccucaugauccuucaagucucagucuaaguuagcaucaguuucucagagaugguuuucuugaccacucucaaucugaauuaggacuguguaucagacugccucaucaagggaaaucccagauuauaagaggagucuugacaggcugugcugcaaucuuagugucugguuuuggcaaugccauucgagucuaauguguauugugugugucugacuauuggaucucuucuaaacuucagcauguuuuuguuucucucaggacucagugugcucuacuuccuguuccugguauuccuacucuuccugaauuucgagcagguuaaaucucuaauguauuggcuagauccaaaucuucgauacgccacaagggaagcagaugucaugguauguacuugucaguggccucuuggagaaacucguagacucuuucuuggguguaagagguaauagacuugacauuuuaaauuguuccuucucuguauuuccuguguaguuaccuaaaaaccaggucucugggaggguuguugaguugcaugguuguccacaggugauagaguucagggaaagaaaauccucucauuacgcaaaggggucugugaggaagaaugcacacuuuaucgucagacagccuugggugugaauucugccucuguuacuugguaguugugggacuuugggcaaaguacuugucagauuauuccauuuuuuuguaaguugacauaguaauacuuacuuggggguuauugugaagugaacaaaguagcauuaucuguggggccuacugcgaggucugccauggugcccccaacaccccauguuguugggccaugcccugggucacgguggcugccccugcaccugucaaugucacucucagcaccugcacucucuggccuugaugccuugauccugcuccacugcuugccacagagaggccaguagucaugaauuaguuuauuucauuuguuacuauuauuuuuaucgaaccauacaaaaaaauuuuauucuuggcuaaaacgacucuauuuuggcuuuuacugaagagacuaauuaugugggaaaaaccaacuauuuuucucuucacugacggugaacacuucugugaccagauguguagguuuuucccacaccagccaauucucuaacuuuccugacaccuggaguuagcgucagaucccacuaguuaagggcccaguuccauaagacugcccacauuucagaugccacucgcaaguccaggcugucaccugugcuucugaccaaucagcuacaaaucagggguucccacaauauccuccuugugcacaaucauuugcuaugauggcucacagaacucagggaaauauuuaaguuugccggcuuauuguaaaggacaugauaaaggauacaggugaauggccagauggagagguaccuagggugagguccagcagaguccucagggcagaagcuucugucucugugguguugggguacaccacccucccagcauguggauguguucacuaaccuggaaacucugaaccccagaguucagagauuuuuauggagacuaucgcauaggcaugaucuuuuuuuuugagacagagucucacucuguugccuaggcuggagugcaguggcacaaucucggcucacugcagccucugucucccagguucaagcgauuauccugcuucagccucccgaauagcuaggauuacaggcgccugccacuacacccggcuaacuuuuguauuuuuaguagagacgguggucucaccacguuggccaggcuggucgcaaacuccugaucucaaaugaucugccugcuucggccuccuagagugcugggauuacaggcaugagccaccacgcuuggccuuuuuuuuuuuuuuuuuuuuuugagauggugccucacucugucgcccaggcuggagcacaguggugugaucucagcucacugcaaccuuggccucccaggaucaagugauucuccugccucagccuccugaggaacugggauuacaggcaugcaccaucacacucggcuaauuuuguauuuuuaguagagacaggguuuuaacguguuggccaggcuggucucaaacuccugaccuugacugauccacacaucucagccuuccaaagugcuggaauuacaggugugagccaccacuacuggcccaugaucaauuuuuuuuucuuuccaagacggagucucgcucugucacccaggcuggaauguaguggcacaaucucggcucacuguaaccuccaccucccugguucaagcaauucuccugccucagccucccaaauagcugggacuacaggcgccugccacuacgccuggcuaauuuuucuauuuuuaguagagacaggguuucaccauguuggccaggcuagucucaaacuccugaccucaggugauuugcccucccauagugcugggauuacaggugugagccacugcacccagacccccaugauuuuuaacucaaucuccagucuugcucuccuuuccggaggauggaaggugggacugaaaguucuaggcuucuaaucaugguuuggucuuucugaugaucagccccaacccaggaacuuaccaagucaccucauuagaacaaaagaugcuccuaucacccaggaaacuccaaggaauuaggagcucugugucaguaacuggggucaaagaacagauauuagaacaaaagaugcaccuggcaccccuauuggucaggaaauugcaaggguuuccggagcucugggcuaggaacuggggacaaggaccaaauuauguauuuauuaugaaucacaauaucacacuauuuuauacuauaauguguucuuuuccaauguuuuuuaaucccaacauuugguacagguuaauuuuuuucugaaaaggagaacgggaauuugggccauagauggguuugcuuugacaaacaagaaguaacacaaagggacuucauaaaagguccaagaaauaaucauucccccauggugacauuggucaaauccuucuuagagugguauuuaaagauuguuaucuauaaauuuuuuaagggauaugcuuaaagcaaaaauaagaaugccagaaauuauuuaucagucuugggggagaaagucuguuuuggaauuuuuuuacucuaagggagagaaugacggagguugacuucuuagccuaugaugaugaugauaaugcagaugacgguuaugagaauaagggcaguuauuuauuaugaauugucuaugucagacacugugcagggcucuuuauauucuacauaagccucgugcaugcaugcuagauguucauaucaccauuuuacaggggaggagauggaagcuuaaaaugcaguaucucacugaaaacacaagccgauggaucucucuggcgucaaaaccugugcuuuucauuuggagugugcuuucaguauauaguuauaaaaauaagugcuuugaugcucacaggagccuuaggaaauagaaauugggagaaagauaccccaaguguaauauuuucccaaacaucuuucuugcauuuuugaacaaaaguggucacauugcaaaguaaacugacuugcagguggaugugcuugugugccucugcugauccaguucucacagccaguaggaggagauugaaucgaaugauaaugcucuugacaccuggcuuucuuaagaauuugacaucacagggacauccagaugucaaaguuacagccccaaguagcugaaccuggcuuuuaaacucuaguuuucaaguauuggcuaaaucuuucuugccaaaguaaagcacgaggcuguguucagccuguagaguucuaacuggugcuaaaacagccucaucuucuccaucucuaaucccaucccuuuauacuucuuuaaauugucuuuugcaauucuaaggaccuauucauuagugguuccuuuaugcaagacaggucuauaauuccuggcuucccagagucccuacucucuccacuccuucauguugcuacccauuccuaaucuugauagaccaugauccaugccugguaucauacauugaaacucagacuucauuuucccuuagaauuaauauuauaaauuaauauuauaaaauauuauauaauauaaauauucauaaaauauauauuauaaauauuauaaacauuuauaaaauauuauaaaucccuuagaauuaauauuauaauauuauaaauauuauaaauuggaucacugaaaucccguuagaggcaguuuuuuguguaauugaaaaguugcugcauuucaaaauauugauucuauucaaaaauaugucuuuaagcuucaauacuggguugucuugaagcagcagucuuuggcuaauuaaugcugacccagcuuuucuucugcauaagacaccaucccaugcuggugggagugggggagagggugggcauguucccuguccucuuagagcuuagagucuacuagaaggcaaauuaaacaaauaauuguuggcuauugaacccuaagacaauuucaacagcuuuuuagaauuuuauuaugaaaaauuuuaaaccuaugcaagaguagagagaaucuauaacuucauguacccaucacccagugucaguauuauugacacaggcccaaacuuguuccaccuuuucaucccacauccuggaauauuuugaaacaguucucaggaauuaaaccuaaaauagaugggcuuuucuuuuuuuuuuuuuuuuuggcauaaccacugaacagugaacaguacgcagugaguguugacauuucugcagucgcuucguaaauguucuguauaguugauuuauucaaaauaggauccagacaagguuuacacauugcauaugauaugucuuuuaaaucucuuuucaucuguaauuccccucaucauguccugaaaauuuauuugucaaagaaaccacauugcuuauucuauaggguuuuucacaucuggauuuugcagcugcauuugcaguaucaucauuuaacauguucuuuuugucccccuauaucuucuauaaaguagaacucagguguaggggcuggaugagauucuagauuccagaucaguuuuuauagugggacugcuucauagcuggugcugcguaucacacuaggaggcacacagugucugguggucucgcuuuuuauaauguuaagauuggucauggcuuugugaggucaacaucaguuuuaagaugcaccaucaauuauagguaugacuuuuuggaggagaaaaaaagaaaccuggggcugagcaugguggcucaugccuguaaucacagcauuuugggaggccauggugggcagaucauaaggucaggaguuugagaccagccugguguuugagaccauguuugagaccaacauggugaaacccugucucuacuaaaaauaugaaaauuagcugggcgugguggcacgcaccuguaaucccagcuacucgggaggcugagacaggagaaucauuugaacccgggaggcggagguugcagugagccgagauggugccacugcgcuccagccuaggcaacgcugucucaaaaaaaaaaaaaaaaaaaaagaaaagaaaccuuauauuuaaagugcuauacauuguaauauauugaaauagucacccuaauucucaaaacaauacagugugaaaaagacgugucauagauucaaggaagcacgauaguuaaaaaugguacagucuguguagagguccugauuggggguguggggagcugggaccagucugagcugggaccagaucaugaggcagagggcccugccugaggcuaggaggcugccagggcugagccagcugggaugaggaguuuagguguuauucuaaguguaugaaaaggccauggaagguuuauaagcagaggagcuacaugaccuguguugauguuuuaggaggucaaucaauaaauaccuccauuucuaguugaguuuggaaacagaaacaagaguucaaaaucucagcugauuucuuccugugaaagcucaguggagcagauugcuuuagaccugggcugaauuaagcaagccugucuuccccuagcccauuagacaaccacaagcugcuucugcaaagcagggccugacccacaaaaauugcugcauggcugggggagcugaugagaaccugugcugucuguaagcaaauaauuuccaaagaggacccaaaagagguuggaucucuuucuucuuccaaagucagcaacugccccagagaggagugaagagauaguugggcuggagaccuggcguguguaguaguggagauccuucuacauugggacgggcaugcuacccaaccccuuucuucccaccuccugccccagacacccuuacacacaugcaugcacguuccgugaucugauuaugauuuucaagaucucucuguagucguaagcuagaugugaauaccuaggugcuuauuauagcaucaucuauacuuuguuauaugccugacacauuccacaguuuucaaaagcuauuauuauggaagucuaagcaagaaauaauaguggcagcgagaugcauaaaagaacaaccuggggagguaaagugaauaggacuugguauuugguuagguguccagcaagcaaggcagaggguaaggccgccaagaucagccuaggaccaguugggaagucagcagaaucugucuuuacccaucuuuugcucacaggcaugcaccuguccacuugacccccuuuccaggcuucagcucuacacugucuucaguuaaagccuguuccuccugguucccaggguucugccugcaugcagcucucuggcugcuuuaaacugcaaugcccuguggcccuuccaggacaaggaccucaggucuuaugaggggauaauuggcaaaucuguucauuacuaacuauacugcaaauagacggauuggucuuuaugauuuuuaaaaugccuuuccgcaugucaaagcauagagcuacuuaauagaguguaaaguccuccagaguuaucugcaagcugugauuacuuuaagagcagccuucuaaaaacagaucuuaccccuuccuuaucuaacccuacacaguguauuccagaguaaagaagaggguggggugguugagacauuugagguugacuggacguggcccugcuccuuaaccuaauauacaaccugcuucagcuaagggcauuucccucugucagccugugauucucugugacaagaacgugcuguuccagaguccgggaagaaacuuuucaucuuauugcagggcaguuuguuucuuuuaaagccuuaucuugacuuacccuauugaauuuuauccucuuuucuccagauuucccauuuacacagcauaaucucacaucauacugcuucucaaaaaauagaauucuuaaaaauguuuguucagcuuugcaaguugaaaugcauuuuaucugagaaggaaaucugaugugugguggguuucagaagagacagggaagcucuuuugcucucagaaaguaucauuucuggaauuuaaaacuauuauaguuuauaggaauuuuuuucagcuggcugauaauagggggugaauauuugccaacucuuacuacugccugucaaauuaauuuugggaagaaaggaugugaaauguagagauucccaguaaauguuauauuaucauauugucaugcagucauaugauaagauauuaaauuacuuagaaauacguauaaucaaaaacaaagauauuagaaauggaaccaacauucugaaaagcuuuguaauuuuuaauauuuaaauuauguaguauccgauauauuuuuggggaggggaguucucuuuuaauuacugaaguugggugcuuuucuucuuuuuucuagcauaacuauuuaaggcuuuacauuuuccucuaaaguucaauuuuuacgugguguauuuucguuaucauuaugacacguuaaaaaaaauuccuauuaugauuucuucuuuaauccaugauacuuagaaauguguguuuaaauuuccaaaucuauugggaaucuuuuauuugugcuuuaguuacuggcuuuaauauuguugcccuguggucugaugacaugaucuaugugauaccacuucuuuaggauauguugagccuuuguaaaauuauuuugcuucucauuuuaaugcagcuuuugcaauucagagcaaagcaguuuugauuuauaaacucaaauacuugucuauuuucccucaaggcccuuaaguuauuaaaacuuucucauuuguuacugagcaggacuuauuuguugucaaguucauaucuauucuuuuuauuuaccggcagaauccuggaagcaaguugauuucuagaguuucacuaauuauucucuuuuuuauuuuaaauaggaguaugcugugaacugccaugugaucaccugggagaggauuaucagccacuuugauauuuuugcauuuggacauuucuggggcugggccaugaaggccuugcugauccguaguuacggucucugcuggacaaucaguauuaccugggagcugacugagguaagaaggagggcauuggggguuccccagacugugccauguguguaguuuauauauaggaaaaaguaugucaguuaacagucaguuaauccguucuccagccccugugguacaaaacaguauuuaaaccaucccauaagaauauuuaauacuucuguuuaaaaaacaagcaaauauuaaaaauaccuccuuguuaacuuaauaaagugcaccucuguccugcaagucuuaaagagaaacaaaugaaauaaagcuaaagaaugaaguuaaaauuccaaguaagacaaauaaaugggaaugaggagaccugcuuagaauucaauagaucaguugaccuacuaacuagcuuccaguuugagauaauagaauuguguguucaaguacuauaagagcauccaggguauuugguagcugcaaaauggauuccaaauguuagcucuaauaugucaguaaucaaaaguuuguugcauuuacuuaauaaaagaguuauagucuugaaaaaccauuagcaaaaugaaauuuugggaacuaacucauuauuguucuauuauuaugaaucauucccagugaacagaauucguccacaugcgcaguauacuucuccaugcucaucauuguccugacccuaacuuagagacgugugccaacuagauguggcuucuguuaaugugccucucacuguucuggaggccagaaguccaagaucaaagcgucggcaggacugguucccccuggggccuuuuggagcauuuuuuucaggcuccuucucuaucuuugugguuugcuggcagucguggucccugggcuuguugaugcaugaccccuuccuggucauguggcauucucccugugcgugucugagccuucaugguguucuuuuuuuuuuuuuuuuuuuuuuuuuugcgacagagucuugcucucgcccaggcuggagugcaguggcacgaucucagcucacugcaagcuccgccuccuggguucacgccauucuccugccucagccucccgaguagcuggaacuacaggcgugugccaccacgcccagcuaauuuuugguauuuuuaguagagacggggucucaccauguuagccaggauggucucaaucuccuguccuugugaucugcccaccucagccucccaaagugcugggauuacaggcgugagccacugugcccagccccauguguucuuuuucauaaggacacaagagcauucccuuuuauaaggacacaagucauauuggauuagcagcucacuguacugccuaugaucucaucuuaacaaaguaccucuccaaugacuaucuccaaauaagcucaaauucugagauauuggagguuagggcuucaacauaggaguuuugagaggacacaauucaaccgauccauaauagugcccaacacuuuacauaugccuucuaaguccucacaacaaaccgggaaaggcggugcauauagguucucacuguacaggugggggaucuggagugcacagccuugcuuccuuaggugaguuaggauuggauuccagaugugaagcccacguuccugcccuuauaccacauuccaccucugaauuccaagugucuuuggaacccagccgcugcauaggcuugugucaggcaccuggcccuugucggccucgcuugcuucccccuugcacugcagacugggcaucugcuguaccuucuuucccugcuucccagugccuguggucaccaggcccuauagaguucuguagagucuucuaagcacccagucguccauugacgucucuucagaccucugcucccaccugucucuaauccauggucaucucugucagaauugcuugucucuucacuauuuauugccaaaugauccucuuuagaccccaccagaccaaggcucuuuccuacucagagcucuuuaguguuuguccauuacucuguuuuuuuuugagacggagucuugcuuuguugcccaggcuggaaugcaguggugcgaucuuggcucacugcaaccuccaccuccugggcucaagcgauucucuugccucagccucccaaguagcugagauuacaggcgugugccaccacacccagcuaacuuuuuauuuuuaguagagaugggguuucgccauguuggccaggcuggucucuaacuccugaccucaggugauccaccugccucagccucccaaagugcugauauuacaggugugaaccaccguaccaggccuccauuacucuuaaaauagaauccaaacuuccaacccugccuacgaggcuccagguucaccggccccugccugcagccucagccucaucaugccucauuuuugcccucagugcugcagccgccucugcugucuuccccaccacagaguccuaccugcugcuccucccucucuucuugcccuucaccugcuaacaagcugucuccagagcucagcucuggaaggcuuucccugccccuccaguaacugugcuccaccuucauacagcuggaaauagaacaccucgccacucuccuuugaaaugcuccucacguguuagacacucgauaagugucucuucugcuaauccuugugccucaagagggcagggcccaugccuauguauucccagacccaaggacuuugccuuauacauggcagaugcuccacaaaucuguagugaaugaaagaaugcagcccccuccuccuugggcuugggucuaucgggggcccaucucacccccagaaccugguaccuuccaggaaaguuccuuaggcuggaggauguccuccacaucccacuuucucuugcauaguuuucuuucagcaaauaugugucauugacuucugcugaaguuucucccuucccucucuaagggcaagaguuaaggcuccaucucguggcuuggaaccugggaauacacuucaaggguaguaccaggccccugggguuaagaaugcagccacaagccaucacaugcagcagcuacucuguagcuucuugacagcagguucauuaagaacaaaaaauuccucauauuuauaauuuguuuauagcuuacaaaaugcuuucaugaauacuguuuuaucuuugcaguauuuauuauauuacuucaaagguuuguaauuacaggcuugucucuuuccagagaacucccaggcauugucuuaguaauuucaucuuuuuacauugggccuucacacucagugggcaugcuguucugaacacaguggauaugcccuuuguuuuggacaaaacaaauugauuucuagagaacuucuguuccacccuugaucuuacuguuuccccuuccuggaaugcccgcaucuucaucuccaucucaugaaaucagucauucuuguccuuaacguucccccuccaauaugucuuucuuguagaagcccucuccaggaaaguuccagaggccaaaagaaccuucagccucagucagaaugaauguuuuuuuccaccauacuccauuuaugucaccauuguaacacuuuccucagucuaccauauuuuaugguucugguuaucuggauaaacaucugaucccagcacuuugggaggcugaggcagguggaucaugaggucaggaguucgagaccagccuggccaacaugguaaaacucuggcucaacugaaaauacaaaaauuagccgggcaugguggugugugcuuauaaucccagcuacuugggaggcugaggcaggagaauugcuugaacccgggaggcagagguugcagugagccgagaucgcaccacugcacuccagccugggcaacagagcaagacucugucucagaaaaaaaaaaaaaaaauacaacaucugacaccuguccuugaaaucaagacccuugacuuccuuuucucucaccaccuugcacaucaugggcacuuaauaaaagauugucauuauugugaaucaguuggugugagauuuccuauuaagcugucaugcuuccuacaucgugucaucaagagcuaacuguucuuuuacaacuuacucacuguuuuaccuaaauaucuaggggauauuuuugaaaugcacaacuugaauucucaagcugcuaauuuugagaauuaugacaaugcuuuguugucaggguuggaaacuuuucuccuuuuccccucccagauccuugucauguugucauuagccaagguaauuaauugguaguauuuuucaagagagaccauucuuucuuuaaaagcccugugucaaaaagagaagagcuguuuggauaugugcuguuuguuugcaaaccaucugcaauauaaaaaacaagaaacagauugcagaaccuguuacuguugguuauuuucuguacauuaggaaaaaaugaaaugucaacaacuucuucuaaaauaauguauuguuaaaaaggaaaucuaucuaucugcaugguaccccaguuuuguuuauuuuuccaaccaugggcucuuguguuucucagcucuucuucaugcaucuccuccccaauuuugccgagugcuggugggaucaagucauucuggacauccuguugugcaauggcgguggcauuuggcugggcauggucguuugccgguuuuuagagaugaggacuuaccacugggcaagcuucaagugaguugccuucuuuuuggauauuagucacaguuuuucaugauauauauuuaauuguuuugguaggaauccauuuuaguaugaucuuugaugauaaggaauaaauuccauguuaauaacugaaacucauaaaugauuauaaaccugauuucaagcauuuguccagaaaaugcucaaucauuuaugauuuucucucucucacccuauguauucaggggguccuaacaccauccuccuaauucaaaagauuucugaaauccacccccacucuuuuuuaucccgacugccucagccuucauucagacucccaucccuggaucaauucaucucuguuuccagguuaaguccuccaguccuucccacaccauugcuugagugaucuuuuuaagaacaucagauucaucaugucauugcccugugauggcuucucauggucuuuggucauggucaauacauccauuaccccaguagggagauccuuucucuacacccucccaggcaaccgagagucuguuugugcacacgcuccccucucuucaccugagauuuggccuguguacccauaggccagccugaucauccuuuucuuugcugacuuagcucacuugccacccaggaaguucucugaauaguuuuaaguugcauaccccacuaugcuuccaguagaggacagucauaccgccggcauugcuuuauccugcuuuguuaaacuugcuucucauuuugcagcacgaaucaugccauugauaaggaagaauaaugguacugauaaugaaaguugugguugcuucaauuguguuuaaaacuuuguuuacucuauauaacaaaauagcauuuucccacaucauuaaauauucuucuaaaacaugauuuuaaagggcuucuuuguacuucaacauauggauaaaccauguaguauuuaaccaguuccauuuuaugguccuuuaguuguuucaaaguuuuugcuuucauaaagaagacuggagugaucauucuuggacauauaucuuagugugcaucgccuuuuuuuugguaaauaaauucuuagaaauagaguguaccaauuuguaaucucaccuauaauauauauguauauccauuucacuauuuccuugaacuucauuuuuaaaccuuugucaaauuuaucacacauaaaauugugugauacuggauuucuaucaauuucuauuggauuuacccucuuuuauuugugcuuucuacagauuaagcuaauuaacacuuugccauaaaugugacuuuauuuuccauuuugucacccccuuuuuuuuuguuuguuuuauugagauggagucuugcucugucacccaggcugcagugcagugguacaaucucggcucgcugcagccuccgccucucaaguagcugggacuucaggcgcgugccaccacgccuggcuaguuuuuguuuuuaguagagaugggguuucaccauguuggccaggcuggucucgaacuccugaccucaggugaucacccgccucagcaucucaaaguguugggauuacaggcgugagccacugugcccagccugucauccccuuuuaaacuaguuugugguggauuuuuuauuuaaacaucaaaaauacuguuaaucuuuuuguuuagguaaauauuaaccaguauuuucuucuaguucuuuuguuuuuuuguuuguuuguuuuuguuuuuuuugagauggaguuucacucuuguugcccaggcuggaaugcaauggcacaaucucggcucacugcaaccuccgccucccagguucaagcgauuuuccugccucagccucccgaguagcugggauuagccaccacgcccggcuaacuuuuuuuuuuguauuuuaggagaaacgggguuucucuguguuggucaggcuggucucgaacuucugaccucaggugauccgcccgccucagccucccaaaguucugggauuacaggcgugagcaccgugcccagccuuucuucuaguucuuuagugguuuuacuuguuuuaaguauuuaaucugucucaaauuuauuuugguauaugaugugaggaggagauuucacaauguuuuugccauugguuaaccaguuuuccccaucccuuuuauuacuaaaccuuucuuuggucacugacuugcaaggacacuuuuuaauauauuuaauuuuaauucuaauuuuuauguauuuguuuuuuugagacagagucuugcucugucacccaggcuggagugcaguggugcaaucucaacucacugcagucuccacuucccggguuuaagcaguucuccugcaucagccuccccagugccuguaauccccaggugggauuacaggcaugcaccaccacacccagcuaauuuuuguauuguuaguagagacaggguuucuccauguuggccaggcuagucucgaacucccaaccucaggugaucugccuuacucggccucccaaagugcugggauuacagguaugagccaccaugcccagccacuuuuuaauauauuuaaggcagcauuuaaccuaauaaaaauaguagccaugcuucaaguauugcuccaagcaagcuucacaagcaauaucucauuugagccuugaaucaguccugaggguagacacuguuauucucuucaguuuaggaaugaugugauacugaggcuuagguuuaguaauuugccuaaggacacacagcuagcaagcagcugagucugaauuugcaccaggaugucugcuuuccuuguuguuguuguuguuguuuuugaggcauagucucacucugucgccuaggcuggagugcaguggcacaaucuuggcucacugcaaccucugucucccagguucaagugauucuccugccucagccucccaaauagcugggacugcaggcacccgccaccacaccuggcuaauuuuuguauuuuuaguagagacaggguuucaccauguuggccaggcugaucucaaacuccugaccucaagugaucugccggccucagccucccaaagugcugggauuagaggcaugagccaccaugccuggccucaggaugucugcuuucuugaacacugcuacaguauacuuccuuguuuucuuauguuuauucuugaaauuugacuucagaaucauuuugucaaguucccacgacauaaacccaacuaauaaacaacaacaaaaaauccuauuggugguuuuuuuaaaguaauauuaaauguauaaaugaauacagauuaaguugaauuaaccucuuugcuguauuaaauauucugauucuugaucacgcugcaucucucuuuauucccauuuucuucucagucuuucuaugcacuuugcuauuuuuacaguacaagucuuuuguaguucuuguuuauuuuuggauagucucuauuuuuugcugccagugugccgcagaucuucuugcugugauguuuucucaauacgaguuuguugguggauagguggguggaugaaggaacagcccugguuuccuaucacucucccugcucccacccacuagaacggaaggccugacugguuggugcuugugccuccaaccacuuagcacaauguuggagacguaaaaguucaugauauaaauauuuguggaauuaaagacucuuuaccaguuauuaaauaguauuuauuauaccuuggguuuuggcucuccuggacuaguacagggagggcuggaaucugcacccacuccucaugcugagugugccagccacuugcugucucugggccuuaaugucugcauuuguaaacuguaggacuguuuaguucuuucaugggugugugaaacuuuuaauugagugauuucgaggaugcaaaugaagaaagguuaaauaucacuguucaucaacccaaaauguuuacugcucuggggaagaaauaggguaaagaaguguugugggugaugcaagaauauggagugugugcaguuuuacgugggagacaagcagugggagaacagucuccuugcugcccugugccugucaucaaugagauuccucauugagugugcuucugucaccugcuuuaccuguauagagagaccuuugagacacaauucaaauaaaaagcagucucuuuguccugagcauuuauuauaaaaaucaucagugcacaggauuuuuuucuugugcuuuguuuucccccugccuuaucucuggauuuucacuggagccauucucuucuuacagggacauucauaccaccaccgggaagaucaagagagcuguucugcaguucacuccugcuagcuggaccuauguucgaugguuugaccccaaaucuucuuuucagagaguagcuggaguguaccuuuucaugaucaucuggcagguauuuuuucagaugcccagaaguugggaggaaaacaaaaacuaaaauaaaaacuuuuuaggaauuuagaguuaacauuaguuuacauugcuuuucagcuccauacuuuacaagauauaauauucugcagcuggcauguagaauaauuaagcaaagugauguuguuaugccuaaggucuugccucauuuugaagacaguuuuaaaauauggaucuuugaauuacaaauuagaaacagauuagauuccgugaaauaauuugugucuagcauccaucauccaaugaguuaggcauuggauugcuuuuuagaaugaucauuuucaagaccaaaggaacaaaugagaaggcuuuucuuacauuccuaauucaguguuuauugguuaaaauuguuccucagcuguuaccacuuugguuaaucuguagggugcuaaaugagugcuggggaauuggagccuuuugcugaguccuccagaguguuguccuccguggagagaagcuguauuuccaaguggcccacuucacgacggaagugauucugacagcccagggucuuggcaaaagauuaucaagcaucuguguuucugagagacagcaauuuuuucugaugcuccuggccccagguuguuucacaacuuuuggaaaguagccaagggaaaccagcuuuugccugaagaggaucuuucagagucaucagaaauuauguuuuggacacauaaacacaaaauacucccaacauaaggaaaaaauuagcagaugucacuuuuaggacagaugaucuuccuuguucacacagagacaaugcccaucgcaauaaaugaaguuuaugcauacagaaguguacgugaauaguuaaguaaguaaucacugugguuuggagaggucaguaucuuuaaaaacaggacuguagauggauugggauuaagcuuugccuuaucaggcccaaugucacggaaagcagaagcuuucuuuuauuacaaggaggaaugauuggaugugucaaggagaguaguauagugccguuaggauggaaccaccuggugguaugcgauggagcacacuguucccaugagugugagcacugcgcugggaucagcuuuccauaugugauauuaauuagacuauuuuuuauuuuguguccuugaagucagugcuaugggaaaacaacaugcauuuuguggaauuguaaugaaccugccagucuauguacuguguucuccuagcacagugaccguuccauaaucuccaccccuuguuugcuaccuggagcugggcucuaggcagagagcagccacgucccagccacaagauauuuugugcuacucaucaugaugaacugcaugaggaugcuaaccucagggaaaaguacuacugcucccagcugaaacuuggaccaacccuucauaccuacuuuuaaggacugccuuugguagaggaucugcucugucccaggcgugugcugcacgaguccaucgucaucucucagaugugucuccagcuucuuuuuuugcuuuuuuuuugagauggaguuuuacucuugucacccaaguuggagugcaauggcgugaucucggcccacugcaaccugcaaccucugccuuccagguucaagcaauucuccugucucagccuccugaguagcugggauuacaggcgcccaccaccaugccuguuuguauuuuuaguagagaugagauuucaccauguuggccaggcuggucucaaacaacuuaccucaggcgaucugcccgccucgggcuuccaaagugcugggguuacaggcaugagccaccgugcauggccucaagccucuuuugauuguuaaagagcuuacuuaucuacauuuggaauucuguuagaccuggccugauuucuguaaggcagcauagguguucuguggcacagguuugcuuucaugacuucuguaugcucaaagcauuucucucccgacuaucccaguggaucacaugugugagcugaguaacaaucauacaaaccaggaaacaugacaaauagcugauaauccuguuccccuaugugcccauccaccaccccugccaccucucccugggccuccaguugcucccugcccauaauguacuggcuguuaacuaguuugaauagcaauccuuggaagaccacaucuauucucugaaaaugcuuugaacauaccaauuauuucuaauuguagaaugucuauuuaaggaauagaggauuuugaauuagcaugagguaccagguugacuaauuucuccgucuuuuucagcugacugaguugaauaccuucuucuugaagcauaucuuuguguuccaagccagucauccauuaaguugggguagaauucucuuuauugguggcaucacagcucccacagugagguaauucugcacaagccugacugucauaugagaacauuaacuugcuuuagauuguccuguuuagcauaaggaaagucauauaaacuagcagauuuuccaugaaaauaccaucguaaagaauuguacauccagaauaugacgaaaauguuuuguucucagaugucaguaacauuaaccagacauuuaaaaagagaagcacuugaugaacaccacaccaauaguacuauccauuauuaucagauuccuuuacagucuuggacugccgaucuuuuuuucuccuauaacaucauauuagaaaaaaauaacagcauagugaugcugaguuuuuuaaaaaugagauuacuggaaaaaugcaaauguuuuuaugguagaacugaagucauaaaugacauuauuuuuugaaugagacuuuuagcuuuuucagacccaauuaauuuaauuuccuuuuaaaaaggcccuuccuguaguccuccaggacaacugagauaagcuuggguguucccgccauuauuccccuggauuaauguggggcccuagaggugaggcuuauucagacaccaucccucaaguagacugggcccagugcaguucaaagcaagcauuuucauuuguuucauuuuuccuauuuagaaauggcauuugaguuuuauaacuaauacggaauacuggcauuaaugaguagcaacaccaaagaucugccaaagguacaaauauaauuuaagcaguuaaaagaguuagcuuuucagaagcuguaagauuguuuauuucauuauuuuuaaugugcuugcaaaccccauaagcagcgggccucacuugccaaggacaguagaucuauaccuuggucaaacagaccuuccagccagcaccucuucuugucaucauucaauauuaccaaaaaaaaaaaaaaaaaaaaaaaaaaaaaaccuccagauccuggauucaacaaaucaaguaagacauguccaaguccugaggaguuaagccuaacauucccaucuguucuuuuuguuaugaccaaaauggaaaagaagaguaagccagcagcccuuugaaacuucguagauuaguggucuauugcagucauuaucucauaaauccuguuuuuucuuaaugguuuagaguccccauuuaaaauguaauuuaauuugagacuuuacaauuuuuuucaggaaagauuuaccgcagcucuuucauaaaauuaagagcaaucaauaaagucaguaagaauggaaagaauuuucuucuuagaacaaaauagcaaaucguauaugauuuaucaugaaauuucaguacuaaacauuccaaaauaaaaacuagacacuaaaaauccaacguuuugaacuuuugagagauccucaaaauuuuacaaugcccuauggauuucuccacaacucucuuuguuuaaaaaaucagacacuuccugugcccuuacacuguuugaggcaguucccauguaaggaguuucuuugacaaguuacucggaaagauggaugugcugcuaauggauuuuaacacagccaccccauuuagcaaauguuaggucccgagaggagagagaguuuagaggcuucaguguaaauccuaacaucuccagcuucuuccuuuuuuauuagacuuucacacgaaucugcuuugagaagauauuugagugaacaugcuuuuaaucugauacuauaaaguacaauauaaggaaauggguccaguuagaguguaaaguagcuaaaaugaucaagacguguuaggucaugacaauaugaaguuagaggaaaagcuacauucuuuauaauuagaauucuucacucuggucuuuggggugagacgacaguaguuuauggaugagcuucagguauucgugaauccucugaacuuuaaugcaaaguguuaugccuuucuuucaucaaauccucaaagagucagugaccccaaaaagaugaugaguuccugguucaggugcuacugcugaagggguagauugaguuucagggguacuuacaagacuccaagccaugcugucccacacagaggccacucaccacguguggcuauugagcacuagggauguggucacuccacaaugaaaugugccgugcauggaaacugcacaccagacuuugaagaguuggggccaaaacagaauauaaaauaccucauuauaauguuuuaauauauuuguuuaaauauuaguuuaacauauuaauaaaauggauuuuguauguuccuuuuuacuuuuuuaacaugucuacuggagaauuuaaaauugcauuuauggcuugcauuauauuucuaccggauggugcuguucugagccuuucaacaccaugucauugccuguuuuuuuucugaacuugucaguaacauuccaagucauuggcauucaauggcagugagauauagcuggggucccauuccaguuucugaaagccaaaaaucuguauauuuuuugccugguuacaaucagcaaccuuuguccuggagagaaccagaggagacaaccaauggacaguacugcucacucucuggagucaccuccauggagcuagacauggaaacacccaccugggguuccuuugcagcgcuguggaagucuuaccacugaauccagacugacuuugucaauaaucuggcucuuuuuagugguuuuuuuuuuuuuuuuuuuuuuuuuuuuuuaggcuagucaagugaagcagugggaguggaaaaggaacaaagaaaucuguaaaugguugcgaucaguuaguuguaaacaccccggcacucagaccagacaagaaucuggcucuuuaaaugaugcuccccugccuccagccuaacccaaacgcugaaucucuuacaggaauguuuuaacaggcacuggcuuucucuucucuugaacagaacuagaccaggcagccugacaugggacaaggagggacguuuuuuacuuugucaaagugauuuaauuaugugcugacuugcuggucuuccagcagcucucaaugaauuccaacuuuguucuuucagacaguacuacgcuuaccucaccgacacacagugcaagcgcguaggaacacaaugcuggguguuugggugaguaaucuguuauuguggagauuuaaaaaccacuuaagcccuaauuuuauuuggguauuucuugacccuguguuaagagccuuucaguauaauuuuucuaugaagacagguggacuagauuuuauauaucuauaucuauaucuauauauacauagauauaucuuuucaucuuuaauauucccuuuucugauuuaaguuaagaauaguuacuuggcaaauuauaaaacaagaguauagaaauggcucucuuauuuuggccgggugcaguggcucaugccuguaauccuaucacuuugggagcccgaggugggcggaucacuugagcccaggaauucgagacuaaccuggucaacauggcgaaacccugucucuacuaaaaguacaaaaauuagcugguugaggcugaggcaggagaaucgcuugaacccgggaggcugagguuucagugagccaaagucacgccacugcacugcacuccagccugggcgauagagugagacuccauguuaaaaaacaaacagacaaaaagaaauggaucucucucuuuuuuuuuuuuuuugagauggagucucacucugucccaggcuggagggcaguggcaugaucucggcucacugcaaccucugccuucugggcucaagugauucuccugccucagccucccaaguagcugggauuacaggugcgcaccaccacacccuacuaaguuuuguauuuucaguagagacgggguuucaccguguuggucaggcugguuucuaacucugaccucaugaucugacccccuuggccucccaaagugcugggauuacaggcaugagccaccgcacccggccuuggcucucuuuuuuuuuuuuuaaauaaauuaggaaaucagaugguauuucccacaaacaacucugagacuuuguuuuaugaaauacauuagagagaaaauggauugguugcauuccuucuggauguaucuugaguuuggaaugccauccugucaugggcugacccacaccccauauuauugucacaucaaaagggccccuuggaacagcugcuugcuauauacugaaguauaauuuuauuguuccaaagaguacuaacauacagcagcauggucacaauggucuuguuauggauucaaauguuauaucuuuuuuuuuuucuuuuugagacggaguguucugucgccaggcuggaguacaguggcgugaucucggcucacugcaaccuccgccucccagguucaagcgauucuccugccucagucccccaaguagcugggacuacaggcgcgugccaccacacccagcuaauuuuuguauuuuuaguagagaugggguuucaccauguuggccaggauggucucgauuucuugaaccucgugauccacccaccuucugccucccaaagugcugggauuacaggcuugagccacugcgcccggccuuaaauguuauauuuuaauuuauuauuuaacugaugagaaagagaccuuagguuaucuaguuuaaccucuugcuguuaaaugugagacccucuugaauaucucaaguaaguuguuuuucuacuuaacaucagcaacaauuuaccaucccauuuagugacugaaauuccagagacauccagcaaaucuguacaugaaguucaauccccaagguggcuuagcuucaagaccuaaucgagguucuaaauggaguaugagaguauaaagaaaaauugaggaaaacccauuauagagaagaaauuacuuuucacagauuuuuaaacaggacauucuuccaauuaaaaaguaauacaugcacaaugauaaaaauucagaaaaggaucuagaaggaacuaaagaucacccaaagaagucaaccauuuagagauaaucauuguuaauauuuuaaugucauuccuuuccauuuuucuguguauguguguguguguuuccagcugucaucuagauucugaagggugacauaguuuuaaaggcuaaaaauguugauacucagguuagauuuaggcagguuccucccgacccuuagaagacuaagggccauugucauuuguuucucuuagguucuaugguguaagcugauuuucuuacccaaagugguuuguuguaaaaggugauaagauggauuugguuuccuuuguucaugauauagcaggagggagaauucacacaucucccagauuucugacagcgcagagguggcgcucccgcuucaugugugagggcccuguguacuggaagaagggaugugggccccuccuucuaaaggauuguccaaggaggaaauggucuuuccuuuuccugcauuugagcucuucugucccacucacacauucuuuccacgugcauuuugcuuucauauuuaaaaguccuuagcaagguccuauuauucugcuguggaguggauuuuuuuuccacagaauuguaucgauuuacguguugagggaaauaagugggucagagagagaggucgcaucaugacaaaguuucuuucuaauuggacagccaugaaacaccauccccacggugggagaaacggcaaagguaaacuccacuauggcggcucacgccuguaaucucagcaauccaggaggcugaggugggaggaucgcuugacgcccggaguuugagacuagccuggguaacauagcgagacguugucuccacaaaaaguuuuuuaaguuaaccaggcaugauggcacaugccuguagucugcuacuguggaggcugaggcaggaggaucacuugaacccaggaugucaaggaggucaagccugcauugagcuaugauugugccucugcacucccacccggaugacagagcaagacccugucucucucuuuuuuuuuuuuuuuaaaaaaaaaaggaaaaaaguaaacaaugccaaagagugguaaacacugccccagaaaguugugccuuauuugaaagugauuaaaauauacugaaaugcaaaggagagaucacugggcuuagugugcuuuacugagaauugagaacucccggaacagugugauaccgagauugaagacucuugugagaaccagugagcuaugcugaaaaauaauaaagcccuccucauaaaucacacccaguggauccuccugugugcgugaacagccgugagagcugcccccugcacaguccacugccagccagggaaggugaaacaggagccacagccuccugcucuccugaccccggaggccacccacuuccuuccucugccccagcucuaccucccugccauuuugucauuauuuccucuccuaucaaaacagaaaacacugaagugugugguuuccuuuaaucacuaauagcugcuuuauagcuuucuuuucacuaauuuuggaaugaucucagacuuugguaagguggagaaaugagagggagcagugccuuaaauagugacuuucugaauguugccuuuugggagguagaaaggggaaggcaaaggucaaauaggaucacccgccugggguucuuucccagcacuccacccuuuuucuccugaagaggguacuuucucuucuauaaagaugguauccucaaaauguuuuuaugaauuacuugcuauuguagcuaaauacaugucaucccuaacgguugugccauagacugagcuuuuaaaccuuuuauacgaaagguguugcacucagcagagagagggcgccauccagcaagggaaugggaucccuaacagagagaaagcagccguguggaaaggucggcuguuucucuauuuagaugucacaugauguuccuucagcucggugggaguuuuggggccagacugaugugaacaaauucuccaggugugggguuuaugucaucuuugucuuuuccccauuccacccugauuagaauugagcuucucugccucaaaaagagaguauuggcccaguuuaaauagaagcaguguuuuaucgccugguccugggaggaagguggccaagcgucggcugaacagcagugcacaguugcuuuuccucuuccugggagugcauggggugggcccucaugggagagugagccuacccugccugagggcccagggcugcauccugccucccagaggcagccagagcugcuccucacccgaccaguuuccucgcugccugugaucccaccucugcuaauguguccaucacaauaaguucccaccucugcugcucuccaaggucagcuccaaaccagccaguccuuuccucauccucuucuuggaucuucugcacauuaucugccuucuugaaacuguccucuuuccucugcaauaucuguccuguauuuccucucacuuuucuguuuucaguucccuuugcuggcuucccauucuaccccucucuccuccuuacaauuucucauaauugugguuuuguucuuuuguucuuccaggcccauaguucaggcuuucuuucuuuuuaaauuuuauuucuuuugagacagggucuugcuguguugcccaggcuggaguugaguggcagugaucacagcucacugcagccuugaccucccagacucaagcaauccucccacaucagccuccuaaguagcugggacuauaggcacacaccacaauguccagcuaauuauauuuuaguuuuuguagagacaggguuucaccauguugcccaggcuggucuugaacuccuggacucaagcaguccucccaccuugaccucucaaagugaugggauuacaggcauuggccacggcacgcagccuagacugucugucuuaaggguagaugcaacuaugagcaugagcuuccuucuagggagagggugcaaacacaggggaacagauguugggaggggggucccuucccagcacaggggagucaccgccguccugcugguauagcuuuauagccaguuccccuucuccucgugacugugucuguucauccucccuuuaucuugccacaccccacccccugcacucaagugcaccuccacugacaucucagaagcucugacaguaguuacauuugagauggagucucacucugucgcccaggcuggagugcaguggugccaucucggcucacugcaagcuccgccucccggguucaugccguucuccugccucagcguccugaguagcugggacuacaggugcccgucaccucgccuggcuaauuuuuuguauuuuuaguagagacgggguuucaccauguuagccaggauggucucgaucuccugaccucgugauccgcccaccucagccucccaaagugcugggauuacaggcgugagccaccacgccuggccuacaaagcuuuuuuuuagcagccgauccccuuucuucaaauggcaucuugccccaaauccuacuaaguaucuaaacgaguaagcagaacaguucugaguuugccauccaagacccgcuucuccccuucccuccuugugccggggauucuuuggaaguuagaaaguugacaggagcacaauaggaauuguaucuauuguuuaugccacacuuagcucuugcuuccuccaaaaaggugucuuugcccacccuaaucagaacuagaagcucacuccugaacuuggaggacccuuccuggcauccugugugauuguguggucauugaguuaacauggauacacaucucauuuccacuauuggaggcugggcccuggcugccaggagagggggucucccacacucucagccauccagggauugcuugugcagccauggagcagugcgugugggaugcagcagccagguacccggccuccauguccauggcauuccuguggcauccucagaauccacgugcaggcuuguuggcaagccaaaaucucuucuucugcuucucaaguuuggcucauacacccagcucacacacacgagccuagagcuuucaugccccagauuccuacaacaacccugccaccaugccuguuccacucaacucaccgaagagcuccugacucugggcucuacauuaacaucaucuuuuuucccacauuguggaacuggcuccacaagucgggggugcugggaguaugugcaccaguaaccagcccuaggucaggaaucucuagugccugcucccagcagaagcaccucaggcugcccaaauguuuauuugccuuuuaacccugcuaaaccaagauacaggaugguggauggcaucaaagggaguggaggcccugacugaauuccauuaagccacaauuuguccaccuagcuuagccugggaaagaucagagagauuuaaauugaacugaguaaagggaccuauugcugagcugugcggaggaaaccccagcaccccugggggugaggaaguaggaggagguauguguucucacacuggcaggcuuaauacaggcucccgcugugcugaagccuccagccucagcccuaaacuagccacucuuugagucuugguagaaaaguaaugucagccuucuggaagggugcuguugauuggaacucccuccagugggccagagguaauggugggggcgauggcuggugguuaaaggagcccaugugaucguuggguuccuaccacuucucaccaucuccacagcccugacccggguccccaugucuggaugaguacaguagccucccugcuucugcucuugucuucucacagaguucuguucagccagcagaagguucucgaauguucaucaccaugcuguucacaauagcaaagacauggaauccaccuagugcccaucagugguggacuggauaaagcaaaugugguacauagacaccauggaauaauacacagccauaaaaaagaaugggaucauguccuuuguagcaacaugggugcagcuggaggccauaauccuaagcaggaaaagaaaaccaaaaaccgcauaugcucacuuaaaagugggagcuaaacauugaguacacauggacauaaacaucagaguaauagacacugcugacuacuagggagggaggaagcggggcaugggugggaaaacuacuugcugggugcuacgcucacuaccuggguccaauauacccauguagcauuccuacacauguacccccuguauguaaaauaaaagcugaaaaaaauuuuaaaaaaacauuaagcaaacuggccaggcgaaguggcucacuccuguaaucccaagcacuuugggaggccaaggugggcggaucacgaggucaggaggucaagaccauccuggccaacauggugaaacuccaucucuacuaaaaauacaaaaaauuagccaggugugguggcacacgccuguagucccagcuacucaguaggcugaggcaggagaaucacuugaacccaggagguagagguugcagugagcugagauugcaccacugcacucuagccugggugacagagugagacuccgucuaaauauauauauauauauguauguguauauauauaugugucuauauauauguguguauauauauauguguguguguguguauauauauauggagagagagagagacagagagagagaagacuguauuaaacccucugcucuagacccucuaggauccccucagacuaaaagccaagccuacggguggccuuccagguccauguuacccugaccucaacucagcccuuuccccugauuccuggcccuuccuugugccuuucccaugcccaggccucagucugggacucuccacacuuauguaaucccauagccggcccccucaccuccuccuagccaccuucucaugagaugugcccacacacacggacaauggcuuagcuaagacuccucagcacauuggcacaaaucauauccuuaaguugcuaacucaaaagcacggucuucagaaaaacuucagguugaccaggugcaguggcucauaccuguaauccuagcacuuugggaagcugagguggguggaucacuugagcucaggaguucgagaccaaucaggguaacacgguaaaaccccgucucuacaaaaaauacaaaaauuagcugggcguagugccgugagccuguagucccggcuacucgggaggcugagguagaagaauugcuugagccugggaaguggagguugccaugagccaagauugugccacugcauuccagccugggcaauggagucagggccggucucaaaaaauuaaaacaaaaaaacagaaaaaacuuuaggucauuaugaagccagugauuggguucuggccaguauuuucuuaaaaugaaacagaauagaaaaauaucagaauaaagaugcaaauugucuuaugaagcuuuuguuucaguguguguguguguguguguguguguguguguguguguguguacacgcaugcguauacuggaucacagugaaaauuguguuucuugcuaugguucuuaaugggucuuagaucacaaaaguuugagaaacacagcuuuagucggccaaucagcaugcuuuuaaaagggcccucaggcuggcucaugccuguaaucccagcacuuugggaggcugagguggguggaucauuugagaugaggaguuggugaccagccuggccaacauggugaaaccccgccucuacuaaaaauacaaaaauuagcugggugugguggcaggcgccuguagucccagcuacucgggagguugaggcaguagaauugcuugaaccgggaggcggagguugcagugagccgcgauugcaccacugcacuccagccugggugacagagcuagacucuauuuaaaaaaaaaaagauagagggccucaagucuaguugaauauucagaaaucuuucauaauaaacucaggguguucuguccggcuuauggguagauaaucacacuuauguccugggcucaacacucccaucauaggaguuauucacgaaguccgagccaaagaugaaaucauccuuuuuaugucuccucacugcacaggcuggaauaccaaacauguaacugccaccuagcgucuuaaucacagucuagacuuuagaaguacagugagaaaaccuucuggguuccuccacugaaaugauacuuucucacaugugacaugcuuuguggagcagugcuuuaaagauucaagccaaccacucuuaaaccuuguuuugguucgggcuaggggaaaagacagccccagacucucuaaagacaaauugaggagaauuucuguugauuuuucugcuuugcugaagugguucuaacuccaggcauuuagaccuucaguuguuuagagccaucuacacuuuugaugauggcagugaccacuaugucugccaguaagcagggguaccaagggccuucuuggccccuucuugccuuuuuuuuuuuuuuuuuuuuuuuuuugaggcagagccucacucugucgcccaggcuggagugcaguggugccaucuuggcuuaccacaaccuccuccacuucucaggcucaagugauucuccugccucagccucccgaguagcugggacuacaggugugugccaccacgccuggcuaauuuuuguauuauuggcagagaugggguuuuaccaucuuggucaggcuggucuugaacuccugaguucaagugauccgcucgccucagccucccaaagugccgagaucacagacaugagccaccaugcccugccccuucuugccuuuuuagaaaacaucugugugaguacaccauucauggaguguacagaucucaucuugagcaaggaaugcauaaaauggacuugucuaaaaucaguauucauaugcugccugggaucucauggccaacuaugucaaccucaccucauccauucuuaccuccaaguccugaaccuuuagaaaggccugauuuuuauagucauaaaugaagauacagaacacaagagugacuuuuuuuaauguuuuaaaggggaaauaaguguguggcguuucuuaaaaaaaaacaaaaaauuuguauuuagcacaaucuuuuacagaucaagagaagguaaaggguuuauauuuucaccaaaaacgggggcuauuucaucuggaaauucuuagaaggcugggaaggaaugugauuaaugccuucaaauuauugaaagacucucuuggaagggucaaacucacccuguguggcagccaccuagccucuuaaucacagucuagacuucagaacuacagugaaaaagccuucuagguuccuccacugaaaugaugcuuucucaccugcgacaugcuaggguaauguuaggacccaggguaggagguauaggaggcagauaccagccugugacaaggaaaaacuuccuaacugcugaagaguuugaccagaaaaauaagccaccuugcaaagguaguaguuucccugugccugagaggguuccagcagaggcggcgugaucacccacccuuauggcaguggaggugcugaguuaggugaugccagugccccuagcuauuaaaauuuaugagucacaauuugggucugggaagaaggaagaggugaaaaauacuuuauuauuuccgaaguaaaugcaguuggcuugaacaguguuauuuugugggguaccugcuaccaguguuugaggcagaaaucgcaugaugaguugaacuuuuucauucaaucaugcauauuuuggauaaaguguaugcucugguaagauggauuaauacuuaaccucuguucucugucuaauuagggucauugguuuccuggaggccauuguuugcauaaaauuuggacaagaucucuucucuaagacccaaauacucuauguugugcuuuggcuucuuugcgugguaagucacugcauuuuacccaaaggcauuagcuaaacucucauaguaucacuuuaaacggaggggggcaaagaaacccucuuguguaucaaaguuccuuagaaauucauaaaaagauguucuacuuguaauugucugagacuggccaccagccuaauuucaagaguaagacacagcuacacaguaucugaaauaggucaccucagcagauuccagucaaacgccuucgacagguacaccccacgugcauuuccuugacucacgagaauuugucugcaugugcuaugcauuuagggaccaccaugaaaggacaagaaagaucacagugcacuuugcuuucucaucaucaugccgcauacaucuuaaccuacauaucauugcacauggauuuauauauaaaaggacauauggucauucauaggcaauaaaauauguuuuggaagauaauucgauccugcaauuucugcccuccagguccacguuauaacccaagccuggauaucaccuuccgcucugaagggaagagccuguagggacaccagccuaagccuugguucuuuugcccuggggcucuucccucaccuuucaaaugaaguaagauaguacccacuuacacauuuuguaacugccauucuucauuuaaauauuugaaguuauuauuuugaagaaaaguucuuauuuuauauuuaagcuuaagauuuuucacuuagucuagaaaauguauugggcuuuuuaaauaaucauagaaaauuucagacaugugcaaauagagaggauagauggccccucaugaacccaucaucgguuaucaacucagggccaauuguguuuccucuuauguuguacucacugccccaacccuaacuuauuuugaaacagauccaccuuuaauauuucaggauggaucacuaaaagaagcucaggauacuuuuucgguuuaaugcaaccacccuaccauuaucauaucuaaaaaagaauuaacaguaauuccuuaauaucaucaaauaccuaaucaguguucaaauuacuaaccuuuucuuaaagguuguauuuguuuaacaauauauuugaauccacauucacccaucgugauugguuggcaugccuuuuaagucucugaauccauagguuuuccucuaucgcuaacccucuuucccucguaauuuaucgguugaagaaagcagcccuuuuguccuauagauuuucccacagucuggauuuuacugauuuuaucguaucuuguaauuuaacauauuucuuuguccucuguauuuucuguaagucgguaauuggaucuagaggcuuaaucacauuugggucuaguuuuuuucuuuucuuuucucuuuuuuggcaagacuaaccuuuguauuuuuaacgugucuuuuaucgccuuuaacgggaucuauuuuuaggguuacuuguuagaaauccuaacuguaccaaggcacagugagccuguucuguccuguuucaucuugaacaauaaaagggaauaaugaucuccuuuguauuuaaacuacagaauuaaugcccaaguauauuuuuucaugucagugagaccagauguaaggaaucgguuagggaaaugugucagacaugcccagagauuuucacuaugcucuucucagauaugucucuggccugugcaccucaagucugaauuguaauaggaccugacugcagggggcagaggugggugcccucuucaccggguaccagagaaccacccgcccacagggagggugagacaggcaggacucccaggacaagacagacagcccuccucaccacagcaaaucacaggccucccagcugccuccccaccacugcccccugggcagcagugaccagaaaggucuucucaggccaccuacccaggcagcccucucuggucccugucuuaguccauuuucuguugcuauaacagaauaccaugggcuugguaauuuacagagaaauuaaaucacaguacuuuauuuggcucacgguucugacagcugggaaguccaagagcgugguaccaguaucuggcaagggucaccccaugauggaagggcagaagggggaagugagcauguaagacagcaggaggugggccggacuuacccuucuuaucaggaacccacucccacgaucacuaaaucacuaacacgcuccugugauaacaaucccacuccugcaauaauagcaucaguccauuuauggggugcacuccucaugaccuaaucaugucuuaaaggccccaccucccaauaucauuacauugacagcuaaguaucaacaugaguuuuggcagggacauucaagccauagcauuccaccccugacccccgcuucucacauacgaaauacauucauuucaugccaguagucccaaaagucuucacuuggcccagcaucaacuccaaaguucagagucucaucuaaaucagauaugagugacagucaaggcacaauucguccugaggugaauuaaccccacuuggacaccaccgcaguuucuggccuauaccuuccagagugguagcucaagccacaccaagguccacuugagccacagccaagaagaacuaugccagcugugagccugugaaaucacacaggucgucuacuuccacaauacaauaaugggacaggcauaggauagacauugcaaaucugaaagggagaaaugggcaagaaaaaagggauaagcagucccaaguaaguacagaacccaacagggaaacauuacaucuuaaagcuggagaauaaucuccuuugacuuuauguucuguguccuggccuggggcaggaguugggcccccaggccuggcagcuccaccccuguggcugugccggguucagccagugcuucaguucuuccaggcgggaguugcacacuggcaacccuacaguucugugguguuggggaugacccugcugccacugcuccucucugguggcuccaaccccacauuucuccuuggcauugcccuaguauuggcucucugcaguggcacugccccuguggcagguuuuugccuagacuucuaggcaguucgccgcauccuuugaaaucuagguggaggaagccauggccuccacagcucuugcguuuugcauaccugcagaauuaacaccacauggacaccaccauggguuauagcuuaucccucccagagugguagcccaagccacaccaaggcccacuugagccacagcuaaggcagccaaggagcacucugcuagaaugugggaguagagucccuagguagcccuggucagugagcccguggagggcuccccaggccuguaaccgaaaaccauucugcccucuuagagcucugggucugugaugggaggggcagccuugaagaucucugaaacgcuuuugcuuucagggaucuuccucacauuuucuugaugaauagcaccugguuucuuucuuuccaugguaaucucuuuaacagccacguggccccacccuuaguguuuggaauaugcuuuuucacuguuuacauggccaggcuuugaauuuuccagauuauuccauucugcuucccuuuuaauuuuaaauugucuuuaagucauuuccuuccucuggaaucucauuguaugcagucagaaguagccacacaguagcccgaaugcuuugcugcuuggcugucuuccaccagauauccuaguucauugcccucaggcugcacacucuagaaagccuucaggcauggacacaauucagccaaggucuuugcuacugugugacaaggaugcccuuuacuccacuuuccaauccuugcuccucauuuccauuugagaccucaucagaguggccuugacuguucauauugcuaccagcauucuggucgggaacgcuuaaguaaucucuaagaagacugaggcuuucccucuuuucuucugagcccucaccaggaucacccguaaugcucccuuuacagcaauacaggcuuuuucuagccugcuccuccaaauucuuucagccucuacccauuagccaguucaaaagcugcuuccauauuuucaaguauuuguuauaguaaccaccccacuuuuugguaccgauuuucugucuuaguccauuuucuguugcuauaacagaauacugcagacuggguaauuucaaaagaaaauaaguuuauucugcucacaguuuuggagguugggaaguccaaaaguauggcaauggcauccagugaggucaucccaugguggaagggcagaaggcagaaacaagugcaccagacagagagggaagugccaaacucauccuuuuuaucaggaacccacucccaagauaacagccugaauccauucaugagggcuuugcccucaugaccuaucaccucuuaaaggccccaccuccuaauacuguuaaguuggcaguuaaguuucgaggagaguuuuggcaaggacauucaaaccauagcagucacucagacuguagggaccccucuaauuucucuuuaaguuuuagagagacuuucuguuacuuauuugacacuuagaauauaucuccuuuuguggguuagccuuuguaucuaugugauuguaacuuauugaggacaugcaccauuucuuaugcucccauugaccucugcuucacuugguacagaccucuuaguccgggcuucauucacagacaguugcugagugcucuuccgugcugugccuggggcucuagccacacagauagaugacggugauaagauuuacuggugccuacuaugugccagagaccauucuaagcacugucaugaauuccacauuugaucuucacacuuugagggaagguauuuuauuaucccucuuuuacagaugaggaaacaaaggcacaaagaaguucacuaacuugcccaaggucacauagguaguuaaguggcagaaccaggacucaaacccagacauucucucuagggaacugcucuucaucacugcccuccaaggaucucugaguucagauggcaauuagacaugcaaacuaauuauguuaauaugugauaaauacuguaaaagauugugugcauaaggcuaaaggauacuuagagcaacagacaugcuggggguuggugaaggcuccuuagugauaugugagcaggauuuuuaaggguugcagugaaccgcuggcuuucccccagccccccaggccccagcuaaaaaccuggaggcugcuuccuguccuccaucacucuucgaaucagccagucacuaagaucuguuaauuugacaaugcagcucaacuccaucuccucuccauucccacugccucugcggcugucaggacacccauuuucuugccauucugcccuccaaauccauucuccaugcugcugucaaaaugaucuuccaaaauucagaacucaaucucuuuccccugcuaagaaucauucucucuggcugggggcuugagagggcacaauaacacaaucuuuuuccccaccugaguuaaaaaauaaguaagagauaagcaagauagaggaaaguuauggggaucagaguagcaucuucauuagugagaauucaccuuuuucaggaaaugccggcuuccuuagucaccauucaaggugugacuucuccccagggaaggagugagggguggagggaagcagugaagcuuccuccacacaagaagaaacuucaagaaggaagaaggcuccccaccacgaaaccucccagaugaauuaugaaaucugcuuguguguucaggaccuucauagugggagcauuccaucacaucugcccacguguacucuauucucaggcugcacuugucugcugguaguuaccuaaacaagucauccuuccagacuucuuuugcccuucccacgcuguuuucucugccugaucugaaagacuuucccugccuuaucuacaugaugaaacugauaccccaaaaccaacuuaaacauaugacccccaugaaauaugcucugaccuccaaggcaaguagauagcucccuccuugggaccaguagugcuuuguacguaacucucaguucuaaccccagugcaguggaauuuguuuuuuuucuaucugucuccuccacacugcacuccuugcucagagagaauaaguugaagucaucuuuuggccccacugucucaagcaccgugccuggugcauaggaagcacucggcagcuucguggagaauaaaggagugaguucaagagacaaaaacuugcgacaugcagguggcuggggggcaaacauacaaagacaggaagcugugagagugcccaguggcucaggaagguggugaccuguuugaggagugacagugaagaguuggaugaagaguaggacaggguccccugcuuaggaagggcuuugugcggcuguaguugcagccccagcaauuuucaagcggggaaacaauguggucugaucugugucucauggggaaacaccauggaggcugggagagucuagagggaagauggguuggggggaagaaguacagucagaggugcugccaggccuaguugacaaguaacugaagcugaaccaaggcagaggcauugaagaugcagaggaagggcuggaucugagaguuguuuaaggaaugugcucaacaggaugccauuccucuugugguagcugggaggggacuugagugccacuccaaagguucuaacuggugccacuggguggccaccagugcuagcgacagauuggaggauauaggagaagcccauugaaaggaggaggugaauuugguucaggggauuuggguuugaggaaccuuuagaauuuacagguggaaguguccuguuuuaugggaaauucuaaucugucaauaacacuggaaggauuuggucguugguggaaauaaaauacuugggaggagcccauguggagggugcaguuggaguccugggauuagguuaagagcucagggaacaugccucugggagaggagcugacugaggcugggauaccuuaauaagaggucaggccggggacgaugagcaggauuuugaagacaggcagaaucucugauuagacuuacaggaugagacaugagagagggacgucgcccgaaaagaggcccugagacaggaugauuaggggucuccacugccucccuuuaaagaagaacagaaacaagguccuggcacuuuuuaaaauauuccugaccuuuauuauaaagagcaagauugaucgcagacucaggaguagaggcgaacauuauucaauaagagagcuucaaguuacaccaugccuucugccccacucagaaaagcaaagccccuaauuacuccccuggccugguaagagagcgcacacggagcuugagauuaaugcagaagcaaagaucccgggugcugguuaauaagcuuuuccaggagcgugguugucugcucggccgucauuaauuugaaugcucauuaccauaauguagaagccaagcugggguccugcgcccuccuugccgccagccccgugguccuggacagccuggcucucaucccacguaguuucuucucgcccccccgcccuuucuuuaaacgaagugugcaauugcuauuuuaaaucugagccuugacauuuucaguggguacgugccuagauuuccacaggugugauugcaaaccuguaaauuaccggcuuccguuugcugggacaaguguaaaaugggccucuuuguacgcaggugaaguagauuuggcaaucacaacagacccuuugugugacgauugugaugauaagcaccugucguucuccacuugccugcuguuugccgcuggagggagcggcagcugccacugccugucauauugggccuggggcuggggaagggaagagccccgcgugccugcccucugguggucagaguuugcaaugacagucuaguugagggacccgccuccccacagcccucucguuuggggagguggaaccuaacccccccaguccgcugugugaaacccagaauguucuguuuugcucuuuguaaggggccuaacgcauacacaggcuuacacucugcaaaucauuucuaguccuucccacucuuuccaugccaugaaaauggcacacuuaacguugguauaucuaagaaaucugggcaagcauuagaguauguuaaagguuggaagucauuuucacuuuguaguuuuaauguauucauucguggccuaauuuuuugauggauaugagcuuuuuaauaaaucccuaaccuguagguauaugccaguuugcacguggguuuaguaggaaaugaaccaguggcgcugcuugugcuucucacucucucuccacgcugccacuguuccugcuuccacguaacuggcacggaagaggacagcuagccagaguguugcucuccuuucuuuuuuggaacuaagaaggcacuguguauccagcagcugccaggaaaugucgcugauaaaggaacugggccaaagcucgacugcaagcugccaugaugagaauucacagccccugccuucccgcccuaccaccagacuguggcugugcagaggagaagcugcugcuguucacuguucccaugaugcuuuucguucucagggauggauacauggauggagaaauaaagcuauauagacauaaagccaauauuuguaucaguagccaucccuuaaacccagauccggggguuucaagagaucugaguuccggcuccaauguucaccucucugagcuuucauucuucuucuggaaaaugaggggcaaugaaauuaauggucucugaggugaccuuuuggaucuaaaguuaugauucuuagaacuaaaauuauuuccuugagaaggucccuccaugcucucacagcuguccccacaguuggugcaagaugagagggguccaggaaaaugacaggugcccagguguccacaggaaaugcagggggagagauggaggcucaacagccaggauggcuugaugugaauggguuucuagagugaggaauuuggaaggagcuggcaguugccuuguuuuguucugguugcuuugcuugcaguggggaagguguggccggggagauucauggcccugcucuaccgcucacccucccucccuccugccuuugguaugcaguccaggcagcuggagacuuuuccuaagcuuugauuuuuugacauguuuugaaacuuuggauucuugucugugcuuuucuuuccuuaaauuaggguauaauuuagggugugggggcaggcccagugaguggggcaaguguggaguagagguugucccugccucugggcacccacaggccacacccuccucauuccacucagggccuuaagagcaucuuuauuuucucuuuguuuuccuauccauauaaccaagaaaaacaaagcaauaaaaacugggguccacucaaaagccuggaaaagcaagggcagcccuguccagcuaagcuccccacccucuacccugggaguguuuguccgugggcccucaggugccgcugugaccucuucccccuagaagcugacacacugaguccucuuagcgcucuccugugauggggaagccgggagagaauggacccugaaaaucagaacuagaacauagaauccucucuaucuucuucaacagaacccgcaaagcuaucaagaaaaugcaucccaccauauugcacaucugaaaauugucuuucuugcuuucugauaguagagucacagguaguaacuguggucucaucauaaccuuuguugucagaagcuuugggugugcacccuccccuugaggucugaucucugccacguccagccguuuuguaaccggcguccagacggcagaaaugcauugaacgguccugcauugauucccacugaaacccugaaguucugggaaauugaacuuuuuugugcagcaucauuuguuuuucucuuccaggcuuucaccacuuuccucugucuguacggcaugauuugguaugcagaacacuauggucaccgagaaaagguauggaaggagaggcaggcauggccauuguuuaaaauaaucaccccgggcucggcaaauucgcucagagcacgugccuguaaggauauggcgagguaaacacugagguuggggccuccaguccugccacugcagaaaccgcaugucacaacucauucccuagccauugcuggcccugcuugugacggcucuguucaguagaccaauauuuuugucuaacuuuuguuagauaaaaaaaguuauguuuguuuggagaaaaaaagaaaagugaugggaaagcuguggacuggcuuuuggaagcuggguuuucuccccagcucuugaacuguguggaggccucuuccuguguuccggccuguggcucuucugggcaaacgcuugcccugaccuucauuuaguagauaugaggauaccauagaaaauagacaugaauggcuuuaagacacgauggccgucugguagacgguaauauuuuuuucgguaaaaauaacacuuucauccuuuauuuacaccuucagucuaaagaacuuaaggcauguuguggaagauugauucugcaucaccugugagaggaaagaaccuuguuuuuauagcagagaaauauaagcacagggagguucugucacuugccagugaugaucccagccugggagaggcagggaugcagcaugcucgccuuuuugcccugccacuucucccagggaguuccuaaaauuccugcacuaagccugucucucucccuagaccuacucggagugugaagauggcaccuacaguccagagaucuccuggcaucacaggaaagggacaaaagguaucuuguucuuguucguuguuuaaaauuuuacuggguccuugagauguggaauuauuaccuauucuuugaguggagaugauauaagccuugaagggucucaggccuacccauugaaugucuccugucacuuauuaagaaacaugcaauggcugggcacgguggcucacgccuguaauccuaacacuuugggaggcugaggugggcagaucacuugagaucaggaguucgagaccagccuggccaacauggugacacccccgucucuacaaaaaauacagaaauuagccaggugugguggcgggcgccuguagucccagcuacucaggacgcugagccaggagaaucgcaugaaccuggaaggcggagguugccaugagccaagaucguaccacugcacuccagccugggcagcagaguaagacucugucucaaaaccacggcacuccagucucggcagcagaguaagacucugucucaaaaaaaaaaaaagaaaagaaaagaaaaagaaacaugcaaaaugcucacaggaucugagugaaagacuugguuuguaagaagaggcuccauguagcucugcccuucgugagggccccacaccauuucaagcacccugaugggaacguucuuccucuuggcuuccaucaugagugaacaggaagaacuguauauccggccaggcacaguggcucacgccuguaaccccagcgcuuugggaugccauggcaggaucauuugaggccagguauuugagaccagcaugggcaacagagcaagacccugucucuacaaaaaucuuaaaaaauuagccagaugugguggcacaugccuguaguuacagcuagucaggagucagagauaggagggucacuugagcccaggaucacucccauguggaagacagaacaagucccugccucuuaaaaaaaaaaaaaaaaaaaaaaaaaaaaaagguacuguguaucaggaggaaaagccuuucaaaagagggggaucauuuuaauggcauuuauucaagaggcagggcaguguaagagauuuuggucguguaguuagggaaccuccacuggccucuaaggaucacuuugggaauauuuggggccaccugguuauuucaaagaauuagacuuguagaauaaugacauugaggugauuucauuggacaguaauuccucgucaauccuuauaagcuacuugggaagcuuggcugaagaaagaaaauuagaaauacuaaagacugaauuuuagcucacaaaauugcucagagaaacggugggccaauggagaagaaagcgcccuguugcagucauucuccuaaguucuuuuggcaucaggcucauuaaagaucucccaggggagacacuaacauacacucugcugagcugcuggccgcccuuuuggggaaaguuucuccugaaccacggaauugaucagugagcggcccguugugaaaucugauagagauggacagaggggcuccccagcuaucuuauuuagaaccaugcccuuacaaacaaccuuggcacuuacagguucuccacugaagagaauuaagcaguaguagagauguauuuacuugauggaauaauaaaaaaagaaaaauaacaaaaacagaagucuucugaguggggaaagaaucucuuagucuaagucaaaugcuccuuacaguggagacuguaacucugguaacuuuuuuuuuguuggcagccucagguggagauuuccuauggggcuggaucagagcccuggggcagagaacccuuuggcuuggccgcuaggccaggcaggggcugaacaaaggcucagcuggagggcagaggcugcccagugcccuccaucgugggcagcaggggccugaauuguaaagauguucuccagaucaaauguagagggugugaaauagcucugauuuuauagugucaagagucuuuccugaugucggguuuagaaggugguguggagcaggugaagggauggaaacccuugguugcagggcaggaugggcaccgcgugguguguguuuuaauugccccucguuugggcuuccguuucacuugugcucucacuucugguccucaccaucaugaccauguccaucauacacaggacagauguacacacgcuucaggaaccacccagacuuuggggcgcuauugcguugaaccccgcgccaccgcgugugcuccuucaguacuaguucuguguuugagagccucgccuucauuuaugaaugaggccacuagggggagugcacguaucagggaagaaccuguuccccggcaagccuagggcggucuggaaagggacagucaccaaucuccagagcccagggugacggugugcucugauuccuuuggccagguucugaagacagcccacccaagcaugcaggcaacaacgaaagccauucuuccaggagaaggaaucggcauuccaagucaaaagucaccaauggcguuggaaagaaaugaaaaacccugguuaaucaaagauguuccagagugccuagaacugagagggaaauggaacucauuuggaacuccccgugaggaggucgaggcgcacagggcaagcaggaagaggcgagggcacuugggggucauuauuugagaucguaagucuuguuucccacagaccuggccgcgucaggcagaucaucgccuggggggccuuugccaacguggggucucuucuaacuucagcacuugacaugcggucaccgguggcagcgcgguguguugaagggaaacgguagcuauucauucacaguugccaagagcagcuccgcgccugcuggaucguggaugcagcguaaacaucuuccuucagacgaggcauuaaccccaugguuaauggacuggucaccaguuuuuauuuuauuuuuaugaaucuaccuuuccauugauugauuuaaguucaggccacuuuucugucuuuuauuugguuacuguuguuauuuguuuuuaaguuaggaugcuuuuuaacagccuuuagaagccgcugcugaaauugauacugggggaaggguuccccuuccuucuagagcagaaaagggagagagguguuguauuccuguuugguaaccucagucuccuguaagaccuccuaccacauggcgaguauacaccaaucaggagaggguagcugccugcauaggagccucgcuuccgauuauucccuucccaauauuauucauccagacuuagccacagugcacaaaagcaaaccugcuagagaggcagugaacaccacagcuucuccccagcuaggugccuuuuacaucggguuuguucuccuuccaugguguguugcugacauugucacugagucccaugugaggugcuggugaguauuaccuuucaucugugccaugcucuagaaccuugaccuugauaguucaccaccucugauggaucccuguuuuaaauaaaaacgauucacuuuaaagccu

SEQ ID NO: 192436 - RNA, 1458 nt, Homo sapiens
uauucggaaggucuauuuuaauaggaaaauguuuuuuaguuggaacguuuuggaaauaagauaacgcaaugucuucuauaguuacucauuuacacugaaacgugauggguaacuuuuagggcguuugcuuccagucacuuuccccugacuccuugaugugauaauuccuuccauaagauacaaccauucucccaagugaugcgaugacgaguaugugcgugacucuggagggaaagggucuacaucugucucugcuugugccucggauggguuuuacaguagacguaccaccgaccccgccucuucaccagguaacaguccuugcagcgcuucuuaaggacagucuuguuuuugaaccccagcgcaggcagcagauggggcaggaggccgggugagagaagugagcgcacugcugccccggguuccacagccacgggggcugcaccucgaauggauccaaauagaaauguggagagggcucgaggcuucaccgugugacgacugagauagagcagaggguucaccauuuuccuuauaaaaagauuugccauguuguggugaaucuaugggagagagaaaaaaaggaguuauagcuucuccugcacuuccaccugcucuuuaaggcuuccuuuucucuguuucacugaggcuugggaaggcagggaccucggggacugaggguguucccauaccagcugcagccucgaccugagcuugaacacugccuuaaucagccaagugugccaggagaauaaggggcaguggacgguggcuuccuucccuuucccgccugcugcaaguguaggugagugugcaaagcccugcgauguugaggagccgcucacuuggcugggagggagcuuaaacuuaggccgcaucccuuuccaaacagacaccaggucaaggacgguucaacugaugagcuccucccuccaacucuucccagacccaggggcccucccucgggccaguuucgggacaggcccccgcuccggaagagcacggaacucuggcaccccggucgcccgccccugcuuccccacgcgccccggcccuuaggguucagcggccccggcugggaagagcugggccugcagggcccggaggacacugcggcaccggagccggcccugcgcgcgggcugugaggucgcguucgggagccgccaguucucccgccccggggucgcuggacacccccuccugucgccaggucgggcgcccacggucggacccgcaccccccaacccuggcccucugagaccgccaggccccggcccacgcuccucugaccgcagcccacucggggagacacgcccgagggucccaagguggccggccccacccucucgcagcccccacucucaagacacccgggaccccugaccugagaagacggcucccuuacccggccgcacgcucucacccggcgccgaccccugcgucugcgcacuggcac

SEQ ID NO: 192437 - RNA, 41876 nt, Homo sapiens
caggcagcgcugcguccugcugcgcacgugggaagcccuggccccggccacccccgcgaugccgcgcgcuccccgcugccgagccgugcgcucccugcugcgcagccacuaccgcgaggugcugccgcuggccacguucgugcggcgccuggggccccagggcuggcggcuggugcagcgcggggacccggcggcuuuccgcgcgcugguggcccagugccuggugugcgugcccugggacgcacggccgccccccgccgcccccuccuuccgccaggugggccuccccggggucggcguccggcugggguugagggcggccggggggaaccagcgacaugcggagagcagcgcaggcgacucagggcgcuucccccgcagguguccugccugaaggagcugguggcccgagugcugcagaggcugugcgagcgcggcgcgaagaacgugcuggccuucggcuucgcgcugcuggacggggcccgcgggggcccccccgaggccuucaccaccagcgugcgcagcuaccugcccaacacggugaccgacgcacugcgggggagcggggcgugggggcugcugcugcgccgcgugggcgacgacgugcugguucaccugcuggcacgcugcgcgcucuuugugcugguggcucccagcugcgccuaccaggugugcgggccgccgcuguaccagcucggcgcugccacucaggcccggcccccgccacacgcuaguggaccccgaaggcgucugggaugcgaacgggccuggaaccauagcgucagggaggccggggucccccugggccugccagccccgggugcgaggaggcgcgggggcagugccagccgaagucugccguugcccaagaggcccaggcguggcgcugccccugagccggagcggacgcccguugggcagggguccugggcccacccgggcaggacgcguggaccgagugaccgugguuucuguguggugucaccugccagacccgccgaagaagccaccucuuuggagggugcgcucucuggcacgcgccacucccacccauccgugggccgccagcaccacgcgggccccccauccacaucgcggccaccacgucccugggacacgccuugucccccgguguacgccgagaccaagcacuuccucuacuccucaggcgacaaggagcagcugcggcccuccuuccuacucagcucucugaggcccagccugacuggcgcucggaggcucguggagaccaucuuucuggguuccaggcccuggaugccagggacuccccgcagguugccccgccugccccagcgcuacuggcaaaugcggccccuguuucuggagcugcuugggaaccacgcgcagugccccuacggggugcuccucaagacgcacugcccgcugcgagcugcggucaccccagcagccggugucugugcccgggagaagccccagggcucuguggcggcccccgaggaggaggacacagacccccgucgccuggugcagcugcuccgccagcacagcagccccuggcagguguacggcuucgugcgggccugccugcgccggcuggugcccccaggccucuggggcuccaggcacaacgaacgccgcuuccucaggaacaccaagaaguucaucucccuggggaagcaugccaagcucucgcugcaggagcugacguggaagaugagcgugcgggacugcgcuuggcugcgcaggagcccaggugaggaggugguggccgucgagggcccaggccccagagcugaaugcaguaggggcucagaaaagggggcaggcagagcccugguccuccugucuccaucgucacgugggcacacguggcuuuucgcucaggacgucgaguggacacggugaucucugccucugcucucccuccuguccaguuugcauaaacuuacgagguucaccuucacguuuugauggacacgcgguuuccaggcgccgaggccagagcagugaacagaggaggcugggcgcggcaguggagccggguugccggcaauggggagaagugucuggaagcacagacgcucuggcgagggugccugcagguuaccuauaauccucuucgcaauuucaagggugggaaugagagguggggacgagaacccccucuuccugggggugggagguaaggguuuugcaggugcacguggucagccaauaugcagguuuguguuuaagauuuaauuguguguugacggccaggugcgguggcucacgccgguaaucccagcacuuugggaagcugaggcagguggaucaccugaggucaggaguuugagaccagccugaccaacauggugaaacccuaucuguacuaaaaauacaaaaauuagcugggcaugguggugugugccuguaaucccagcuacuugggaggcugaggcaggagaaucacuugaacccaggaggcggaggcugcagugagcugagauugugccauuguacuccagccugggcgacaagagugaaacucugucuuuaaaaaaaaaaaguguucguugauugugccaggacaggguagagggagggagauaagacuguucuccagcacagauccuggucccaucuuuagguaugaagagggccacaugggagcagaggacagcagauggcuccaccugcugaggaagggacaguguuuguggguguucaggggauggugcugcugggcccugccguguccccacccuguuuuucuggauuugauguugaggaaccuccgcuccagcccccuuuuggcucccagugcucccaggcccuaccguggcagcuagaagaagucccgauuucacccccuccccacaaacucccaagacauguaagacuuccggccaugcagacaaggagggugaccuucuuggggcucuuuuuuuucuuuuuuucuuuuuaugguggcaaaagucauauaacaugagauuggcacuccuaacaccguuuucuguguacagugcagaauugcuaacucggcgguguuuacagcagguugcuugaaaugcugcgucuugcgugacuggaagucccuacccaucgaacggcagcugccucacaccugcugcggcucagguggaccacgccgagucagauaagcgucaugcaacccaguuuugcuuuuugugcuccagcuuccuucguugaggagaguuugaguucucugaucaggacucugccugucauugcuguucucugacuucagaugaggucacaaucugccccuggcuuaugcagggagugaggcgugguccccgggugucccugucacgugcagggugagugaggcguugcccccaggugucccugucacguguagggugagugaggcgcggcccccgggugucccugucccgugcagcgugauugagguguggcccccgggugucccugucccgugcagggugagugaggcacuguccccgggugucccugucacgugcagggugagugaggcgcgguccccgggugucccugucacguguagggugagugaggcacuguccccgggugucccucucagguguagggugagugaggcgccguccccgggugucccugucacguguagggugagugaggcgugguccccgggugucccugucccgugcagggugagugaggcgcuguccccgggugucccugucacgugcagggugagugaggcgcgguccccgggugucccugucacguguagggugagugaggcaccgucccugggugucccucccagguguagggugagugaggcgcuguccccgggugucccucucagguguagggugagugaggcgcggccccaggugucccugucacguguagggugagugaggcaccgucccugggugucccucccagguauagggugagugaggcacuguccccgggugucccugucacgugcagggugagugaggcgcgguccccaggugucccugucacguguagggugagugaggcacuguccccgggugucccugucccgugcagggugagugaggcgcgguccccaggugucccugucccgugcagggugagugaggcgccguccccgggugucccugucacgugcagggugagugaggcacggcccccgggugucccugucacgugcagggugagugaggcgcggcccccgggugucccugucacgugcagggugagugaggcgcggcccccgggugucccugucacgugcagggugagugaggcgcgguccccgggugucccugucacgugcagggugagugaggcgcgguccccgggugucccugucacgugcagggugagugaggcgcgguccccgggugucccugucacgugcagggugagugaggcacgguccccgggugucccugucccguguagggugagugaggcacuguccccgggugucccugucacguucagggugagugaggcgcgguccccgggugucccugucacguguagggugagugaggcaccguccccgggugucccugucacgugcagggugagugaggcgcuguccccgggugucccugucacgugcagggugauugacgcgaggcccccgggugucccugucacgugcagggugagugaggcgccguccccgcgugucccugucacgugcagggugagugaggcgccguccccgggugucccugucacguguagggugagugaggugccguccccgggugucccugucacguguagggugagugaggcgccguccccgggugucccugucacguucagggugagugaggcacggcccccgggugucccugucacguguagggugagugaggcgcgguccccgggugucacugucacguguagggugagugaggcacuguccccgggugucccugucacguguagggugagugaggcgcggcccccgggugucccugucacgugcagggugagugaggcgcggcccccgggugucccugucacguguagggugagugaggcgcggcccccgggugucccugucacgugcagggugagugaggcgcggcccccgggugucccugucacgugcagggugagugaggcgcggcccccgggugucccugucacgugcagggugagugaggcacggcccccgggugucccugucacgugcagggugagugaggcgcggcccccgggugucccugucacuugcagggugagugaggcacuguccccgggugucccugucacguucagggugagugaggcgcgguccccgggugucccugucacguguagggugaaugaggcacuguccccgggugucccugucacgugcagggugagugaggcgccguccccgggugucccugucacgugcagggugauugacgcgaggcccccgggugucccugucacgugcagggugagugaggcgccguccccgcgugucccugucacgugcagggugagugaggcgccguccccgggugucccugucacguguagggugagugaggcgccguccccgggugucccugucacguguagggugagugaggcgccguccccgggugucccugucacguguagggugagugaggcgccguccccgggugucccugucacguguagggugagugaggcgccguccccgggugucccugucacgugcagggugagugaggccccguccccgggugucccugucacguguagggugagugaggcacuguccccgggugucucugucacguguagggugagugaggcgccgucccugggugucccucucagguguagggugagugaggcgccauccccgggugucccugucacguguagggugagugaggcgccguccccgggugucccugucacguguagggugagugaguugcggcccccgggugucccucucaggugcagggugagugaggcgcugucccugggugucccugucucguguagggugagugaggcucuguccccagguguccuuggcguuugcucacuugagcuugcuccugaauguuugcucuuucuauagccacagcugcgccgguugcccauugccuggguagauggugcaggcgcagugcugguccccaagccuaucuuuucugaugcucggcucuucuuggucaccucuccguuccauuuugcuacggggacacgggacugcaggcucucgccucccgcgugccaggcacugcagccacagcuucagguccgcuugccucuguugggccuggcuugcucaccacgugcccgccacaugcaugcugccaauacuccucucccagcuugucucaugccgaggcuggacucugggcugccugugucugcugccacguguugcuggagacaucccagaaaggguucucugugcccugaaggaaagcaagucaccccagcccccucacuuguccuguuuucucccaagcugccccucugcuuggcccccuuggguggguggcaacgcuugucaccuuauucugggcaccugccgcucauugcuuaggcugggcucugccuccagucgcccccucacauggauugacguccagccacagguuggagugucucugucugucuccugcucugagacccacguggagggccggugucuccgccagccuucgucagacuucccucuugggucuuaguuuugaauuucacugauuuaccucugacguuucuaucucuccauuguaugcuuuuucuugguuuauucuuucauuccuuuucuagcuucuuaguuuagucaugccuuucccucuaagugcugccuuaccugcacccuguguuuugaugugaaguaaucucaacaucagccacuuucaaguguucuuaaaauacuucaaaguguuaauacuucuuuuaaguauucuuauucugugauuuuuuucuuugugcacgcuguguuuugacgugaaaucauuuugauaucagugacuuuuaaguauucuuuagcuuauucugugauuucuuugagcagugaguuauuugaacacuguuuauguucaagauauguagaguaucaagauacguagaguauuuuaaguuaucauuuuauuauugauuucuaacucaguuguguaguggucuguauaauaccaauuauuugaaguuugcggagccuugcuuugugaucuagugugugcaugguuuccagaacuguccauuguaaauuugacauccugucaauagugggcaugcauguucacuauauccagcuuauuaagguccagugcaaagcuucugucuccuucuagaugcaugaaauuccaagaaggaggccauagucccucaccugggggaugggucuguucauuucuucucguuugguagcauuuaugugaggcauuguuaggugcaugcacgugguagaauuuuuaucuuccugaugagugaaucuuuuggagacuucuaugucucuaguaaucuaguaauucuuuuuuuaaauugcucuuaguacugccacacugggcuucuuuugauuaguauuuuccugcugugucuguuuucugccuuuaauuuauauauauauauauauauuuuuuuuuuuugagacagagucuuggucugucgcccagggugagugcaguggugugaucacaggucaguguaacuuuuaccuucuggccugagccguccucucaccucagccuccugaauagcuggaacugcagacacgcaccgcuacaccuggcuaauuuuuaaauuuuuucuggagacagggucuugcuguguugcccaggcuggucucaaacucuuggacucaagggauccaucuaccucggcuucccaaagugcugaauuacaggcaugagccaccaugucuggccuaauuuucaacacuuuuauauucuuauaguguggguauguccuguuaacagcauguaggugaauuuccaauccagucugacagucguuguuuaacuggauaaccugauuuauuuucauuuuuuugucacuagagacccgccuggugcacucugauucuccacuugccuguugcauguccucguucccuuguuucucaccaccucuuggguugccaugugcguuuccugccgaguguguguugauccucucguugccuccuggucacugggcauuugcuuuuauuucucuuugcuuaguguuacccccugaucuuuuuauugucguuguuugcuuuuguuuauugagacagucucacucugucacccaggcuggaguguaauggcacaaucucggcucacugcaaccucugccuccucgguucaagcaguucucauuccucaaccucaugaguagcugggauuacaggcgcccaccaccacgccuggcuaauuuuuguauuuuuaguagagauaggcuuucaccauguuggccaggcuggucucaaacuccugaccucaagugaucugcccgccuuggccucccacagugcugggauuacaggugcaagccaccgugcccggcauaccuugaucuuuuaaaaugaagucugaaacauugcuacccuuguccugagcaauaagacccuuaguguauuuuagcucuggccaccccccagccugugugcuguuuucccugcugacuuaguucuaucucaggcaucuugacacccccacaagcuaagcauuauuaauauuguuuuccguguugaguguuucuguagcuuugcccccgcccugcuuuuccuccuuuguuccccgucugucuucugucucaggcccgccgucugggguccccuuccuuguccuuugcgugguucuucugucuuguuauugcugguaaaccccagcuuuaccugugcuggccuccauggcaucuagcgacguccggggaccucugcuuaugaugcacagaugaagauguggagacucacgaggagggcggucaucuuggcccgugagugucuggagcaccacguggccagcguuccuuagccagugagugacagcaacguccgcucggccuggguucagccuggaaaaccccaggcaugucggggucugguggcuccgcggugucgaguuugaaaucgcgcaaaccugcgguguggcgccagcucugacggugcugccuggcgggggagugucugcuuccucccuucugcuugggaaccaggacaaaggaugaggcuccgagccguugucgcccaacaggagcaugacgugagccauguggauaauuuuaaaauuucuaggcugggcgcgguggcucacgccuguaaucccagcacuuugggaggccaaggcggguggaucacgaggucaggaggucgagaccauccuggccaacaugaugaaaccccaucuguacuaaaaacacaaaaauuagcugggcgugguggcgggugccuguaaucccagcuacucgggaggcugaggcaggagaauugcuugaaccugggaguuggaaguugcagugagccgacauugcaccacugcacuccagccuggcaacacagcgagacucugucucaaaaaaaaaaaaaaaaaaaaaaauucuaguagccacauuaaaaaaguaaaaaagaaaaggugaaauuaauguaauaauagauuuuacugaagcccagcauguccacaccucaucauuuuaggguguuauuggugggagcaucacucacaggacauuugacauuuuuugagcuuugucugcgggaucccguguguaggucccgugcguggccaucucggccuggaccugcugggcuucccauggccauggcuguuguaccagauggugcagguccgggaugaggucgccaggcccucagugagcuggaugugcaguguccggauggugcacgucugggaugaggucgccaggcccugcugugagcuggauguguggugucuggauggugcaggucaggggugaggucuccaggcccucggugagcuggagguauggaguccggaugaugcagguccggggugaggucgccaggcccugcugugagcuggauguguggugucuggauggugcaggucaggggugaggucuccaggcccucggugagcuggagguauggaguccggaugaugcagguccggggugaggucgccaggcccugcugugagcuggauguguggugucuggauggugcaggucuggggugaggucaccaggcccugcggugagcugggugugcggugucuggauggugcaggucuggagugaggucgccagacggugccagaccgugcggugagcuggauaugcgguguccggauggugcaggucuggggugagguugccaggcccugcugugaguuggaugugggguguccggaugcugcagguccggugugaggucaccaggcccugcugugagcuggauguguggugucuggauggugcaggucuggggugaggucgccaggcccugcugugagcuggauguguggugucuggauggugcaggucuggagugaggucgccaggcccucggugagcuggaugugcaguguccagauggugcagguccggggugaggucgccagacccugcggugagcuggaugugcggugucuggauggugcaggucuggagugaggucgccaggcccucggugagcuggauguauggaguccggauggugccgguccggggugaggucgccagacccugcugugagcuggauaugcgguguccggauggugcaggucaggggugaggucuccaggcccucggugagcuggagguauggaguccggaugaugcagguccggggugaggucgccaggcccugcugugagcuggaugugcggcgucuggauggugcaggucugggguguggucgccaggcccucggugagcuggagguauggaguccggaugaugcagguccggggugaggucgccaggcccugcugugagcuggaugugcggcgucuggauggugcaggucugggguguggucgccaggcccucggugagcuggagguauggaguccggaugaugcagguccggggugagguugccaggcccugcugugagcuggaugugcuguauccggauggugcagguccggggugaggucgccaggcccugcugugagcuggaugugcuguauccggauggugcaggucuggggugaggucaccaggcccugcggugagcugguugugcaguguccgguugcugcagguccggggugaguucgccaggcccucggugagcuggaugugcgguguccccguguccggauggugcagguccagggugaggucgcuaggcccuuggugggcuggaugugccguguccggauggugcaggucuggggugaggucgccaggccuuuggugagcuggaugugcggugucugcauggugcaugucuggggugaggucgccaggcccuuggugggcuggaugugugguguccggauggugcagguccggcgugaggucgccaggcccugcugugagcuggaugugcggugucuggauggugcagguccggggugagguagccaaggccuucggugagcuggaugugggguguccggauggugcagguccggggugaggucgccaggcccugcgguuagcuggauaugcgguguccggauggugcagguccggggugaggucaccaggcccugcgguuagcuggaugugcggugucuggauggugcagguccggggugaggucgccaggcccugcugugagcuggaugugcuguauccagauggugcagguccggggugaggucgccaggcccugcagugagcuggaugugcuguauccggauggugcaggucuggcgugaggucgccaggcccugcgguuagcuggauaugcggugucggauggugcagguccggggugaggucaccaggcccugcgguuagcuggaugugugguguccggauggugcaggucuggggugaggucgccaggcccugcugugagcuggaugugcuguauccggauggugcagguccggggugaggucgccaggcccugcggugagcuggaugugcuguauccggauggugcaggucuggcgugaggucgccaggcccugcggugagcuggaugugcaguguacggauggugcagguccggagugaggucgccaggcccugcggugggcuguauguguguugucuggauggugcagguccggggugaguucgccaggcccugcggugagcuggauguguggugucuggaugcugcagguccggggugaguucgccaggcccucggugagcuggauaugcgguguccccguguccgaauggugcagguccagggugaggucgccaggcccuuggugggcuggaugugccguguccggauggugcaggucuggggugaggucgccaggcccuuggugagcuggaugugcgguguccggauggugcagguccggggugaggucaccaggcccucggugaucuggauguggcauguccuucucguuuaagggguuggcuguguuccggccgcagagcaccgucugcgugaggagauccuggccaaguuccugcacuggcugaugaguguguacgucgucgagcugcucaggucuuucuuuuaugucacggagaccacguuucaaaagaacaggcucuuuuucuaccggaagagugucuggagcaaguugcaaagcauuggaaucagguacuguauccccacgccaggccucugcuucucgaaguccuggaacaccagcccggccucagcaugcgccugucuccacuugccugugcuucccuggcugugcagcucugggcugggagccaggggccccgucacaggccugguccaaguggauucugugcaaggcucugacugccuggagcucacguucucuuacuuguaaaaucaggaguuugugccaaguggucucuaggguuuguaaagcagaagggauuuaaauuagauggaaacacuaccacuagccuccuugccuuucccugggaugugggucugauucucucucucuuuuuuuuuucuuuuuugagauggagucucacucuguugcccaggcuggagugcaguggcauaaucuuggcucacugcaaccuccaccuccuggguuuaagcgauucaccagccucagccuccuaaguagcugggauuacaggcaccugccaccacgccuggcuaauuuuuguacuuuuaggagagacgggguuucaccauguuggccaggcuggucucgaacucaugaccucaggugauccacccaccuuggccucccaaagugcuggguuuacaggcuaagccaccgugcccagcccccgauucucuuuuaauucaugcuguucuguaugaaucuucaaucuauuggauuuaggucaugagaggauaaaaucccacccacuuggcgacucacugcagggagcaccugugcagggagcaccuggggauaggagaguuccaccaugagcuaacuucuagguggcugcauuugaauggcugugagauuuugucugcaauguucggcugaugagagugugagauugugacagauucaagcuggauuugcaucagugagggacgggagcgcuggucugggagaugccagccuggcugagcccaggccaugguauuagcuucuccgugucccgcccaggcugacuguggagggcuuuagucagaagaucagggcuuccccagcuccccugcacacucgagucccuggggggccuugugacaccccaugccccaaaucaggaugucugcagagggagcuggcagcagaccucgucagagguaacacagccucugggcuggggaccccgacguggugcuggggccauuuccuugcaucugggggagggucagggcuuucccugugggaacaaguuaauacacaaugcaccuuacuuagacuuuacacguauuuaauggugugcgacccaacauggucauuugaccaguauuuuggaaagaauuuaauuggggugaccggaaggagcagacagacguggugguccccaagaugcuccuugucacuacugggacuguuguucugccuggggggccuuggaggccccuccucccuggacaggguaccgugccuuuucuacucugcugggccugcggccugcggucagggcaccagcuccggagcacccgcggccccaguguccacggagugccaggcugucagccacagaugcccagguccagguguggccgcuccagcccccgugcccccaugggugguuuugggggaaaaggccaaagggcagaggugucaggagacuggugggcucaugagagcugauucugcuccuuggcugagcugcccugagcagccucucccgcccucuccaucugaagggauguggcucuuucuaccuggggguccugccuggggccagccuugggcuaccccaguggcuguaccagagggacaggcauccuguguggaggggcauggguucacguggccccagaugcagccugggaccaggcucccuggugcugauggugggacagucacccuggggguugaccgccggacugggcguccccaggguugacuauaggaccagguguccaggugcccugcaaguagaggggcucucagaggcgucuggcuggcauggguggacguggccccgggcauggccuucagcgugugcugccgugggugcccugagcccucacugagucggugggggcuuguggcuucccgugagcuucccccuagucuguugucuggcugagcaagccuccugaggggcucucuauugcagacagcacuugaagagggugcagcugcgggagcugucggaagcagaggucaggcagcaucgggaagccaggcccgcccugcugacguccagacuccgcuucauccccaagccugacgggcugcggccgauugugaacauggacuacgucgugggagccagaacguuccgcagagaaaagaggguggcugugcuuugguuuaacuuccuuuuuaaacagaagugcguuugagccccacauuugguaucagcuuagaugaagggcccggaggaggggccacgggacacagccagggccauggcacggcgccaacccauuugugcgcacagugagguggccgaggugccggugccuccagaaaagcagcguggggguguagggggagcuccuggggcagggacaggcucugaggaccacaagaagcagccgggccagggccuggaugcagcacggcccgagguccuggauccguguccugcuguggugcgcagccuccgugcgcuuccgcuuacggggcccggggaccaggccacgacugccaggagcccaccgggcucugaggauccuggaccuugccccacggcuccugcaccccaccccuguggcugcgguggcugcggugaccccgucaucugaggagaguguggggugagguggacagagguguggcaugaggaucccgugugcaacacacaugcggccaggaacccguuucaaacagggucugaggaagcugggagggguucuaggucccgggucuggguggcuggggacacuggggaggggcugcuucuccccugggucccuaugguggggugggcacuuggccggauccacuuuccugacugucucccaugcuguccccgccaggccgagcgucucaccucgagggugaaggcacuguucagcgugcucaacuacgagcgggcgcggcgccccggccuccugggcgccucugugcugggccuggacgauauccacagggccuggcgcaccuucgugcugcgugugcgggcccaggacccgccgccugagcuguacuuugucaaggugggugccggggacccccgugagcagcccugcuggaccuugggaguggcugccugauuggcaccucauguuggguggaggagguacuccugggugggccgcagggagugcaggugacccugucacuguugaggacacaccuggcaccuaggguggaggccuucagccuuuccugcagcacauggggccgacugugcacccugacugcccgggcuccuauucccaaggagggucccacuggauuccaguuuccgucagagaaggaaccgcaacggcucagccaccaggccccggugccuugcaccccaguccugagccaggggucuccuguccugaggcucagagaggggacacagcccgcccugcccuuggggucuggaguggugggggucagagagagagugggggacaccgccaggccaggcccugagggcagaggugaugucugaguuucugcguggccacugucagucuccucgccuccacucacacagguggaugugacgggcgcguacgacaccaucccccaggacaggcucacggaggucaucgccagcaucaucaaaccccagaacacguacugcgugcgucgguaugccgugguccagaaggccgcccaugggcacguccgcaaggccuucaagagccacguaagguucacgugugauagucguguccaggaugugugucucugggauaugaaugugucuagaaugcagucgugucugugaugcguuucugugguggagguacuuccaugauuuacacaucugugauaugcguguguggcacgugugugucguggugcauguaucuguggcgugcauauuugugguguguguguguguggcacguguguguccauggugugugugccuguggugugcaugugugugugucugugacacgugcauguucaugcugugugcugcaugucugugaugugccuauuuguggugugugugugugcauguguccgugacauaugcgugucuauggcauggguguguguggccccuuggccuuacuccuuccuccuccaggcaugguccgcaccauuguccucacgcucucgggugcugguuuggggagcuccacauucaggguccucacuucuagcaugggugccccuguccugucacagggcugggccuuggagacuguaagccagguuugagaggagaguagggaugcuggugguaccuuccuggaccccuggcacccccaggaccccagucuggccuaugccggcuccaugagauauaggaaggcugauucaggccucgcuccccgggacacacuccucccagagcggccgggggccuuggggcucggcaggggugaaaggggcccugggcuuggguucccacccaguggucaugagcacgcuggagggguaagcccucaaagucgugccaggccggggugcagaggugaagaaguaucccuggagcuucggucuggggagaggcacauguggaaacccacaaggaccucuuucucugacuucuugagcuaucgcagcuacuugcaaaucucagcagaauuuuacccucauggaaagcugauggccaccaccugugcccagguguagaaagucacuagagcccaggagacccccccguccccaccgcccaccugugcccggguguagaaagucaccagagcccaggagacccccccccacauccccgcugcagcggaagcuaccgcccccaccgugacccucguuccgaccucgaccuccauggucucccucucccggucuccaugugagugagaucaggcaggagguggguuuugggguucgagccucagcuaugcugaacgccucagcugugcguucuguccaugaauggcauccguuguggaacucgccacguggauguauccuucccgcugcuguggaggcuccugggugcggacugcacggcugcgccugcugugagccugcuggguucugggagugucccaggggucagaggcccucgccucugggugaauuccaggggugggguugcugggucacagacgugcuuuagggauguugugggaguuuccaggggggugacagugacaccccggcuggcugcuugugagggcgaugccuccgguggccgcuggccugaaggugucgaagccgccucgugggauugugcagggggcucucuugaugcccacgugcccacaguguucccgugcuggccgccccggggcucuugcgggagguggcuguccguccugccccgcucuguauggggcgccugccugccaucaucggcuugcaggagcucuuuguguguucugcugcaaguguggcaucacaugcgugcacugugaaucucugugccgugugugucuugcuuuugugcucucaagucaagccuuuugaggacuggaagauuguacuucuaucgcaguccacuaacacaguccaguaacgcaguccacuuuaucagcuguuuguggcuaaagcuguuuguguucucugcaggaacucaagguauugagguuguggugacguugcuucugcgccuccuuuuagaacagucuuuacugugucagcuugcaaaccuggguggggauugguggaauugguuuucaugugugggguagguggggaucugugggauugguuuucaugugugguguagguggagaucugugaauugguuuucauccgugggguagguggggaucugugggauugguuuuuaugugugggguaggugggauugguuuucaugugcgggguagguggggaucugugggauugguuuucuugugugggguagguggggaucugugggauugguuuuuaugugugggguagguggggauaugugaauugguuuucauccgugggguagguggggaucugugggauugguuuuuaugcgugggguagguggggaucugugaauugguuuucauccgugggguagguggggaucugugggauugguuuucaugugugggauagguggggaucuguggaguugguuuucaugugugguguagguggagaucugugaauugguuuucauccgugggguagguggggaucugugggauugguuucuaugugugggguagguggggaccugugggauugguuuuuaugugugggguagguggggaucugugaauugguuuucauccgugggguagguggggaucugugggauugguuuucaugugugggguagguggggaucugugggauugguuuucaugugugggguagguggggaucugugggauugguuuucaugugugggguagguggggaucuguggaguugguuuuuauguguggggguagguggggaucuguggaguugguuuucauguguaggguagguggagaucugugggauugguuuucaugugugggguagguggggaucugugggauugguuuucaugugugggguagguggggaucugugggauugguuuucaugugugggguagguggggaucuguggaguugguuuucaugugugggguagguggagaucugugggauugguuuucaugugugggauagguggggaucugugggauugguuuuuaugagugggguaacacagaguucaaggcgagcuuucuuccuguagugggucugcaggugcuccaacagcuuuauugaggagaccauaucuuccuuugaacuauggucggguuuauaguaagucagggguguggaggccuccccugggcucccuguucuguuucuuccacucuggggucguguggugccugcugugguguguggccggugggcagggcuuccaggccuccuuguguucauuggccuggauguggcccuggcuacgcuccguccuuggaauuccccugcgaguuggaggcuugcuuucuuucuuuuuuucuuucuuuuuuuuuuuuuuugauaacagagucucgcucuuuuuugcccaggcuggagugguuuggcgugaucuuggcucacugcaaccugugcuuccugaguucaagcaauucucuugccucagccucccaaguagcuggaauuauaggcgcccaccaccaugcugacuaauuuuuguaauuuuaguagagacgagguuucuccauguuggccaggcuggucucgaacuccugaccucaggugauccucccaccucggccucccaaagugcugggaugacaggugugaaccgccgcgcccggccgagacucgcuuccugcagcuuccgugagaucugcagcgauagcugccugcagccuuggugcugacaaccuccguuuuccuucuccaggucucgcuaggggucuuuccauuucaugacucucuucacagaagaguuucacgugugcugauuucccggcuguuuccugcguaauuggugucugcuguuuaucgauggccuccuuccauuuccuuuaggcuuuguuuauuguuguuuuuccggcuccuugaaggaaaaguuucgauuauggauguuugaacuuucuuuucuaaacaagcaucugaaguugccguuuucccucuaaagcagggaucccgaggccccuggcuguggaguggcaccggucuggggccuguuaggaacccggcgcacagcgggaggcuaggugggguguggggagccagcguucccgccugagccccgccccucucagaucagcaguggcaugcggugcucagaggcgcacacacccuacugagaacugugcgugagaggggucuagauucugugcuccuuaugggaaucuaaugccugaugaucugagguggaaccguuugcucccaaaaccauccccuuccccacugcuguccuguggaaaaaucgucuuccacgaaaccagucccugguaccacaaugguuggggacccugugcuaaagaccugcuucagcagccucucgucaguguugauauauuggcuuuucuguguugaguccagaauaauuacggauuucugugaugcuuuccgccgaccucagacccaugggcuauuugugggcguguugccugcuccuggguugggaagggugcaggccccauguaccuuccuguuacugccuuccagguugguucucaggguugaaucguacucgaugugguuuuagcccacggcccugccgccagcuccugggggcuggggaacaugcugaagcacagagucaccgugcgcgucuuuugaugccucacaagcucgaggccuccuguguccguguuagugugugucacgugccugcucacauccugucuuggggacgcaggggcuuagcaggucccguaguaaaugacaagcguccugggggagucugcagaauaggaggugggggugccggucucucucccgcgucuucagacucuucuccugccugugcuguggcugcaccugcaucccugcaaucccuccagcacugggcuggagaggcccgggagcucgagugccacuugugccacgugacuguggauggcagucggucacgggggucugauguguggugacuguggauggcgguuggucacaggggucugauguguggugacuguggauggcggucguggggucugauguggugacuguggauggcggucguggggucugauguggugacuguggauggcggucguggggucugauguguggugacuguggauggcgguuggucccgggggucugauguguggugacuguggauggcggucguggggucugauguggugacuguggauggcggucguggggucugauguggugacuguggauggcggucguggggucugauguguggugacuguggauggcgguuggucccgggggucugauguguggugacuguggauggcgaucggucacaggggucugauguguggugacuguggauggcggucguggggucugauguguggugacuguggauggcggucguggggucugauguggugacuguggauggcggucguggggucugauguguggugacuguggauggcggucguggggucugauguggugacuguggauggcggucguggggucugauguguggugacuguggauggcggucguggggucugauguguggugacuguggauggcggucguggggucugauguguggugacuguggauggcggucguggggucugauguggugacuguggauggcggucguggggucugauguguggugacuguggauggcgguuguggggucugauguguggugacuguggauggugaucggucacaggggucugauguguggugacuguggauggcggucguggggucugauguguggugacuguggauggcgguuggucccgggggucugauguguggugacuggauggcgaucggucacaggggucugauguguggugacuguggauggcggucguggggucugauguguggugacuguggauggcggucguggggucugauguggugacuguggauggcggucguggggucugauguguggugacuguggauggcggucguggggucugauguggugacuguggauggcggucguggggucugauguguggugacuguggauggcggucguggggucugauguguggugacuguggauggcggucguggggucugauguguggugacuguggauggcggucguggggucugauguguggugacuguggauggcggucguggggucugauguggugacuguggauggcggucguagggucugauguggugacuguggauggcggucguggggucugauguggugacuguggauggugaucggucacaggggucugaugugugguagcugcagguggagucccaggugugucuguagcuacuuugcguccucggccccccggcccccguuucccaaacagaagcuucccaggcgcucucugggcuucaucccgccaucgggcuuggccgcagguccacacguccugaucggaagaaacaagugcccagcucuggccggggcaggccacauuuguggcucaugcccucuccucugccggcaggucucuaccuugacagaccuccagccguacaugcgacaguucguggcucaccugcaggagaccagcccgcugagggaugccgucgucaucgagcaggucugggcacugcccugcaggguugggcacggacucccagcaguggguccuccccugggcaaucacugggcucaugaccggacagacuguuggcccuggggggcaguggggggaaugagcugugaugggggcaugaugagcugugugccuuggcgaaaucugagcugggccaugccaggcugcgacagcugcugcauucaggcaccugcucacguuugacugcgcggccucucuccaguuccgcagugccuuuguucaugauuugcuaaaugucuucucugccaguuuugaucuugaggccaaaggaaaggugucccccuccuuuaggagggcaggccauguuugagccguguccugcccagcuggccccucagugcugggucugaggccaaaggaaacgugucccccuucuuaggaggacgggccguguuugagccacgccccgcugagcgggccucucagugcugggucuguccacguggcccuguggcccuuugcagauguggucuguccacguggcccuguggcucuuugcagaugccuguuagcacuugcucggcucuaggggacagucguguccaccgcaugaggcucagagaccucugggcgaauuuccuuggcucccaggguggggguggagguggccugggcugcugggacccagacccugugcccggcagcugggcagcaacuccuggaucacauaugccauccgggccacggugggcugugugggugugagcccagcuggacccacagguggcccagaggagacauucugugucacacacucugccuaagcccaugugugucugcagagacucggcccggccagcccacgauggcccugcauuccagcccagccccgcacuucaucacaaacacugaccccaaaagggacggagggucuuggccacgugguccugccugucucagcacccaccggcucacucccaugugucucccgucugcuuucgcagagcuccucccugaaugaggccagcaguggccucuucgacgucuuccuacgcuucaugugccaccacgccgugcgcaucaggggcaagugagucagguggccaggugccauugcccugcggguggcugggcgggcuggcagggcuucugcucaccucucuccugccccuuccccacugcccuucugcccggggccaccagagucuccuuuucuggcccccgcccccuccggcuccugggcugcaggcucccgaggccccggaaacauggcucggcuugcggcagccggagcggagcaggugccacacgaggccuggaaauggcaagcgggguguggaguugcuccugcguggaggacgaggggcggggggugugucugggucaggugugcgccgagcguuugagccugcagcuugucagcuccaaguuacuacugacgcuggacacccggcucucacacgcuuguaucucucucucccgauacaaaaggauuuuauccgauucucauuccugucccugucgugugacccccgcgagggcgcgggcucuucucucugugacuagauuucccaucuggaaagugcgggguugaccguguaguuugcuccucucggggggccugugguggccauggggcaggcggccugggagagcugccgucacacagccacugggugagccacacucacggugguagagccacagugccuggugccacaucacguccucuggauuuuaaguaaaaccacacaccucccggcaggcaucugccugcgacccugugugugccuggggagagugguagcacggaggaaauucgugcacacucaaggucaucagcaaggucauccgcagucagguggaacguggaggccucucucugggaucgucuccagcggauaaaggacugugcacagcuucggaagcuuuuauuuaaaaauauaacuauuaauuauugcauuauaaguaaucacuaaugguaucagcaauuauaauauuuauuaaaguauaauuagaaauauuaaguaguacacacguucuggaaaaacacaaauugcacauggcagcagagugaauuuuggccgagggacacgugugcacauguguguaagcggcccccaggcccacagaauucgcugacaaagucaccuccccagagaagccaccacgggccuccuucguggucgugaauuuuauuaagauggaucaagucacguaccguccacguguggcagggcuuuggggaaugugaggugaugacugcguccucaugcccugacagacaggaggugacugugucuguccugucccuaggacacggacaggcccgaagcucuaguccccaucgugguccaguuuggccucugaauaaaaacgucuucaaaaccuguugccccaaaaacuaagaacagagagaguuucccaucccaugugcucacaggggcguaucugcuugcguugacucgcugggcuggccggacuccuagaguuggugcgugugcuucugugcaaaaagugcaguccucuugcccaucacugugauaucugcaccagcaaggaaagccucuuuucuuuucuuucuuuuuuuuuuuuugagacggaacgucacuguugucugccugggcuugagugcaguggcgcgaucucaacucacugcaaccuccgccucccggguuccagcauuucuccugccucagccucccgagcagcugagauuacaggcacccacccccugcgccuggcuaauuuuuguauuuuuaguagagagggguuuuugccauguuggccaggcuggucucgaacuccugaccucaggugauccacccaccucggccucccaaagugcugggauuacaggugugagccaucacgcccagccggaaagccucuuuuuaaggugaccaccuauagcgcuucccgaaaauaacaggucuuguuuuugcaguaggcugcaagcgucucuuagcaacaggaguggcguccugugggcucuggggauggcugagggucgcguggcagccaugccuucugugugcaccuuuagguuccacggggcuauucugcucucacuguuugucugaaaacgcacccuuggcauccuuguuuggagaguuucugcuucucguuggucaugcugaaacuaggggcaagguuguauccguuggcgcgcagcggcuacauguagggucaugagucuuucaccguggacaaauuccuugaaaaaaaaaaaaggaguccgguuaagcauucauuccgggucaagugucugguucugugaauaaacucuaagauuuaagaaaccuuaaugaaagaaaaccuugaugauucagagcaaggauguggucacaccuguggcuggaucuguuucagccgccccagugcauggugagaguggggagcagggauuguuuguucagaggucucaucugguauguuucugagguguuugccggcugaaugguagacgugucguuuguguguaugagguucugugucuguguguggcucgguuugaguguacgcauguccagcacaugcccugcccgucucucaccugugucuucccgccccagguccuacguccagugccaggggaucccgcagggcuccauccucuccacgcugcucugcagccugugcuacggcgacauggagaacaagcuguuugcggggauucggcgggacgggugaggccuccucuuccccaggggggcuuggguggggguugauuugcuuuugaugcauucaguguuaauauuccuggugcucuggagaccaugacugcucugucuugaggaaccagacaagguugcagccccuucuugguaugaagccgcacgggagggguugcacagccugaggacugcgggcuccacgcaggcucuguccagcggccauguccagaggccucagggcucagcaggcgggagggccgcugcccugcaugaugagcaugugaauucaacaccgaggaagcacaccagcuucugucacgucacccagguuccguuaggguccuuggggagauggggcuggugcagccugaggccccacaucucccagcaggcccucgacagguggccuggacugggcgccucuucagcccauugcccaucccacuugcauggggucuacacccaaggacgcacacaccuaaauaucgugccaaccuaaugugguucaacucagcuggcuuuuauugacagcaguuacuuuuuuuuuuuuaauacuuuaaguucuaggguacaugugcacgacgugcagguuaguuacauauguauacaugugccauguuggugugcugcacccauuaacucaucauuuacauuagguauaucuccuaaugcuaucccuccccacuccccccaucccaugacaggcccuggugugugauguuccccacccuguguccaaguguucucauuguucaguucccaccugugagugagaacaugugguguuugguuuucuuuccuugcaauaguuugcucagagugaugguuuccagcuucguccaugucccuacaaaggacaugaacucauccuuuuuuaugacugcauaguauuccgugguguauaugugccacauuuucuuaauccagucuaucaucgauggacauuuggguugguugcaagucuuugcuacugugaauagugccgcaauaaacauacgugugcaugugucuuuauagcagcaugauuuauaauccuuuggguauauacccaguaaugggauggcugggucaaaugguauuucuaguucuagauccuugaggaaucaccacacugucuuccacaaugguugaacuaguuuacacucccaccaacaguguaaaaguguucuggugcuggagaggauguggacagcaguuauuuuuuuaugaaaauaguaucacugaacaagcagacaguuagugaaggaugcgucaggaagccugcaggccacacagccauuucucucgaagacuccggguuuuuccugugcaucuuuugaaacucuagcuccaauuauagcauguacaguggaucaagguucuucuucauuaagguucaaguucuagauugaaauaaguuuauguaacagaaacaaaaauuucuuguacacacaacuugcucugggauuuggaggaaaguguccucgagcuggcggcacacuggucagcccucugggacaggauaccucuggcccauggucauggggcgcugggcuugggccugagggucacacagugcaccaugcccagcuuccuguggauaggaucugggucucggaucaugcugaggaccacagcugccaugcugguaaagggcaccacguggcucagagggggcgagguucccagccccagcuuucuuaccgucuucaguuauuuuucccuaagagucugagaaguggggccgcgccugauggccuucguucgucuucagcuggcacagaauugcacaagcugaugguaaacacugaguacuuauaaugaaugaggaauugcuguagcaguuaacuguagagagcucgucuguuggaaagaaauuuaaguuuuucauuuaaccgcuuuggagaauguuacuuuauuuauggcuguguaaauuguuugacauucagucccucguagacagauacuacguaaaaaguguaaaguuaaccuugcuguguauuuucccuuauuuuaggcugcuccugcguuugguggaugauuucuuguuggugacaccucaccucacccacgcgaaaaccuuccucaggugaggcccgugccgugugucuguggggaccuccacagccugugggcuuugcaguugagccccccguguccugccccuggcaccgcagcguugucucugccaaguccucucucucugccggugcuggauccgcaagagcagaggcgcuuggccgugcacccaggccugggggcgcaggggcaccuucgggagggaguggguaccgugcaggcccugguccugcagagacgcacccagguuacacacguggugagugcaggcggugaccuggcuccugcugcucuuuggaaagucaagaguggcggcuccuggggccccagugagacccccaggagcugugcacagggccugcagggccgaggcggcagccuccuccccagggugcaccugagccugcggagagcaggagcugcugagugagcuggcccacagcguucgcugcggucacguuccugcgugggguuguuugggaucggugggagaauuuggauuugcugagugcugcugucuugaaccacggagauggcuaggaguggguuucagaguugauuuuugugaaucaaacuaaaaucaggcacaggggaccuggccucagcacaggggauuguccaauguggucccccucaagggcgccccacagagccggugggcuuguuuuaaagugcgauuugacgagggacgagaaaccuugaaagcuguaaagggaacccucagaaaauguggccgccaggggugguuucaggugcuuugcugggcuguguuugugaaaacccauuuggacccgcccuccaaguccacccuccagguccacccuccagggccgcccugggcuggggguaugccuggcguuccuugugccgcagcccggagcacagcaggcugugcacauuuaaauccacuaagauucacucggggggagcccaggucccaagcaacugagggcucaggaguccugaggcugcugaggggacagagcagacggggaacgcugcuucuguguggcaaguuccugagggugcuggccagggagguggcucagaguguauguuggggucccaccgggggcagaacucugucucugaugagucggcagccauguaacaggaagggguggccacagggagcugggaaugcaccaggggagcugcgcagcuggccgaggucccagggccaggccacaggaagggcagggggacgcccggggccacagcagaggccgcaggaagggaaggggaugcccaggccagagcagaggcuaccgggcacaggggggcucccugagcugggugagcgaggcucaugacucggcgagggaaccuccuugacgugaagcugacgacugguguugcccagcucacagcccagccaggucccgcgccugagcaggaacucagaacccuccccuuugucuaaagcacagcagaugccuucagggcaucuaggagaaaacaggcaaagucguugagaaacgucuuaaaagaaggugggaugguggcaauuucuuguccagauuuuagucugccccggaccacagaugagucuauaacgggauugugguguugccauggggacacaugagauggaccaucacagaggccacuggggcugcaccucccaucugaguccuggcugucccggguccaggccagguucuugcaugcucaccuaccuguccugcccgggagacagggaaagcaccccgaagucuggagcagggcuggguccaggcuccucagagcuccugccaggcccagcacccugcuccaaaucaccacuucucugggguuuuccaaagcauuuaacaagggugucagguuaccuccugggugacggccccgcauccuggggcugacauugccccucugccuuaggacccugguccgaggugucccugaguauggcugcguggugaacuugcggaagacaguggugaacuucccuguagaagacgaggcccuggguggcacggcuuuuguucagaugccggcccacggccuauuccccuggugcggccugcugcuggauacccggacccuggaggugcagagcgacuacuccaggugagcgcaccuggccggaaguggagccugugcccggcuggggcaggugcugcugcagggccguugcguccaccucugcuuccguguggggcaggcgacugccaaucccaaagggucagaggccacagggugccccucgucccaucuggggcugagcagaaaugcaucuuucugugggagugagggugcucacaacgggagcaguuuucugugcuauuuugguaaaaggaaauggugcaccagaccugggugcacugaggugucuucagaaagcagucuggauccgaacccaagacgcccgggcccugcugggcgugagucucuccaaacccgaaacacaggggcccugcugggcaugagucccucugaacccgagacccuggggcccugcugggcgugagucucuccgaacccagagacuucagggcccuuuugggcgugagucucuccgcugugagccccacacuccaaggcucauccacagucuacaggaugccaugaguucaugaucacgugugacccaucaggggacagggccaugguguggggggggucucuacaaaauucuggggucuuguuuccccagagcccgagagcucaaggccccgucucaggcucagacacaaaugaauugaagauggacacagaugcagaaaucugugcuguuucuuuuaugaauaaaaaguaucaacauuccaggcagggcaagguggcucacaccuauaaucccagcacuuugggaggccgagguggguggaucacuugaggccaggaguuugaggccaaccuaaccaacauagugaaauuccauuucuacuuaaaaaauacaaaaauuagccuggccugguggcacacgccuguaguccccgcuaugcgggaggcugaggcaggagaaucauuugaacccaggaggcagagguugcagugagccgagaucacaccacugcacuccagccugggcaacagagugagacuucaucuuaaaaaaaaaaaaaaaaguaucagcauuccaaaaccauaguggacagguguuuuuuuauucuguccuucgauaauauuuacuggugcugugcuagaggccggaacugggggugccuuccucugaaaggcacaccuucaugggaagagaaauaagugguggaugguuguuaaaccagagguuuaaacugggguccugucguucugaguuaacaguccagaucuggacuuugccucuuuccagaaugcucccugggguuugcuucaugggggagcagcagguguggacacccucgugaugggggagcagcaggugcagacgcccucaugaugggggaguggcaggugcagacacccuugugcauggugcccagcaugucccuguugcagcucccuccccacaaggaugccggucuccugugcuccccacagucccugcuucccucucacagccuuaccugguccuggccuccacuggcuuugucugcaugauuuccacauuuccugggcucccagcaccucuucgccucucccaggcaccucugcagugcuggccauaccagucagcugugaacuguccacugcuuauuuugcuccccaugaaauguauuuuuuaggacaggcaccccugguuccagccucuggcacagcaucagugaauguuauugaaggacaaaggacagacaaacaaaucaggaaaauggguucucucuaaacacauugcaaagccacagaggcuagugcaggaugggugggcaucaggucaucagauguggguccaaugccagaauauucugugcucccaaaggccacuuggucagagugugugcuugcagagguggcucuaaaagcucagcaguggaggcagugguucgccauacucagggugaacucacauccucugugucugaaguauacagcagaggcuugaagggcaucugggagaagaaaacaggcaaaaugauuaagaaaagugaaaaaggaaaagugguaagaugggaauuuucuuguccagauuuuagucucccaaaccacagcucagaugguagaauguggucagaacugauggacagaacaauagaacaaaacggaagcccuaucucucagaaacguguguuaaugugguauguggcacagcugauggaaaagagaguguguguguaauuuuuuuuucugagaaaacugacuggaagcaaauaaguugugucuuuacagcauauaccagagcagauucuagguagaagaggagacacaugcaaacaacaccagcaacagaaauaaaacaaaagacucaaagggaagggaggugaacguucccugguuugguguuggggaaggacacacagggaggcggaugaaaccagugaggcaacgggcauugcuuucacugcagagaaacucagcuugccugagccacagugaaaauggccauucccuggagcguuugugcacgugauuuauuuaaggcgcccugugagguccugcacauucauccucucacuuuguucuccuaaccaccugagagguagaggaggaaaggcuccaggggagcagccgcccuuggucacccagcuggcaaagggcaugcaugauugcagccuggccuccugcuccggggcccuugcucugcccgaggaccccacacaagucagacccauaggcucagggugagccggagcccaaggucguguuggggauggcugugaaagaagaaauggacgucugaugcacacuugggaagguccuaccagcagcgucaaagaaaugcaugugaaacugacagcgagacccaucccucaaagaaacgcacgugaaacugauggcgagaccuguccccaucccucaugcuggcuccuuuucugggcuugccaagagccagcaucagguugaggcaagcuggaaagacuuuucuggaaagcagcuuguuugcauggaaguccucacaauguccugugucuucccaguaauuccacuucugaagugaccagacauuaucacgggucuuauuuaccauuuccaguguuccaggcagggggacuugccacagcaagucacgaaccugcccaaauacagggcuaaggagauauuaugcaucacaaaacuugcucugccauuaaacauuuuucaaagaauuuuugaagaauguuuaauggcacaaaacguuuauuucaauguagcaguguucaaagcuggauguaaaagaacacaccccaggagccugccguggaugucauguguguucaucuuuggacauggacauacaugggcagugagugguggugaggcccuggaggacaucggugggaugccuccauccugccccucuggagacaccaugugugccacgugcacucacuggagcccuguuuagcuggugccaccuggcucuuccaucccugagauucaaacacagugagauuccccacgcccaacucaguguucucccacaaaaaaccugagucacaccuguguucacucgagggacgcccgggagccagggcuccacaguuuauuauguguuuuuggcugaguuaugugcagaucucaucagggcagaugaugagugcacaaacacggccgugcgagguuuggauacacucaacaucacuagccagguccugguggaguuuggucaugcagagucuggauggcauguagcauuuggaguccauggagugagcacccagcccccucgggcugcagcgcaugccccaggcaggacaaggaagcgggaggaaggcaggaggcucuuuggagcaagcuuugcaggagggggcuggguguggggcaggcaccugugucugacauuccccccugugucucagcuaugcccggaccuccaucagagccagucucaccuucaaccgcggcuucaaggcugggaggaacaugcgucgcaaacucuuuggggucuugcggcugaagugucacagccuguuucuggauuugcaggugagcaggcugauggucagcacagaguucagaguucaggaggugugugcgcaaguaugugugugugugugugcgcgcgugccugcaaggcugauggugacuggcugcacguaagagugcacauguacgcauauacacgugagcacauacaugugugcauguguguacaugaaggcauggcagugugugcacaggugugcaagggcacaagugugugcacaugcgaaugcacaccugacaugcauguguguucgugcacagucgugugggcauucacgugaggugcaugcgugugggugugcagugugaguagcaugugugcacauaacauguauugagggguccucguguucaccccgcuagguccucagcaccagugccacuccuuacaggaugagacggggucccaggccuuggugggcugaggcucugaagcugcagcccugagggcauugucccaucugggcauccgcguccacucccucuccugugggcuucuguguccacucccccucuccugugggcguccacacccccucuccugugggcauccgcauccacucccucuccugugggcaucuguguccacucccucucuccugugguuguccguguccacuccccccuccugugggcguccgcguccacucccucuccugugggcaucugcauccacucccucucuccugugggcgucuguguccacucccccucuccugugggcauccgcguccacucccucuucugugggcaucugcauccacucgucucuccugugggcguccguguccacucccccucuccugugggcaucugcguccacucccucucuccugugggcauccguguccacucccccucuccugugggcauccauguccacucccucuccugugggcaucugcguccacucccucuccugugggcaucugcgucugcucccucucuccugugggcguccguguccacuccccccuccugugggcguccgcguccacucccucuccugugggcaucugcguccgcucccucucuccugugggcguccguguccacuccccccuccugugggcguccgcauccacucccucuccugugggcaucugcgucugcucccucucuccugugggcguccauguccacucccucuccugugggcaucugcguccacucccucuccugugggcauccgcguccacucccucuccugugggcaucugcauccacuccaucuccugugggcauccacguccacucccucuccugugugcaucugcauccacuccacucccccucuccugugggcauccgcguccacucccucuccugugggcaucugcauccacucccucucuccugugggcguccguguccacucccccucuccugugggcauuuacauccacuccauucccucucuccugugggcgucuguguccacucccccucuccugugggcauuuacauccacuccacucccucucuccugugggcauccgcguccacucccccucucugugggcaucugcguccaccuccccucucugugggcauuugcguccacucccucuccugguuccuuccugucuuggccgagccucgggggcaggcagaugacacagagucuugacucgcccagggugguucgcagcugccgggugagggccaggccggauuucacugggaagagggauaguuucuugucaaaauguuccucuuucuuguuccaucugaauggaugauaaagcaaaaaguaaaaacuuaaaaucccagagagguuucuaccguuucucacucuuucuuggcgacucuaggugaacagccuccagacggugugcaccaacaucuacaagauccuccugcugcaggcguacaggugagccgccaccaaggggugcaggcccagccuccagggacccuccgcgcucugcucaccucugacccggggcuucaccuuggaacuccuggguuuuaggggcaaggaaugucuuacguuuucaguggugcugcugccugugcacaguucuguucgcguggcucugugcaaagcaccuguucuccaucucuggguagugguaggagccgguguggccccagguguccccacugugccugugcacuggccgugggacgucauggaggccaucccagggcagcaggggcaugggguaaagagauguuuauggggagucuuagcagaggaggcugggaaggugucugaacaguagaugggagaucagaugcccggaggauuuggggucucagcaaagagggccgaggugggugcaggugagggucgcuggccccacccccgggaaggugcagcagagcuguggcuccccacacagcccggccagcaccugugcucugggcauggcugugcuccuggaacguucccuguccuggcuggucagggggugccccugccaagaaucgacaacuuuaucacagagggaagggccaaucuguggaggccacagggccagcuucugccuggagucagggcaggugguggcacaagccucggggcuguaccaaagggcagucgggcaccacaggcccgggccuccaccucaacaggccucccgagccacugggagcugaaugccaggaggccgaagcccucgccccaugagggcugagaaggagugugagcauuuguguuacccagggccgaggcugcgcgaauuaccgugcacacuugaugugaaaugaggucgucgucuaucguggaaacccagcaagggcucacgggagaguuuuccauuacaaggucguaccaugaaaaugguuuuuaacccgagugcuugcgccuucaugcucuggcagggagggcagagccacagcugcauguuaccgccuuugcaccagcuccagaggcuugggaccaggcugucucaguuccagggugcguccggcucagaccgcccuccucucugccuucucucucugccucaaaucuucccucguuugcaucucccugacgcgugccugggcccucgugcaagcugcuugacuccuuuccggaaacccuuggggugugcuggauacaggugccacugaggacuggaggugucugacacugugguugaccccaggguccagcuggcgugcuuggggccuccuugggccaugaugaggucagaggaguuuucccaggugaaaacuccugggaaacucccagggccaugugaccugccaccugcuccucccauauucagcucagucuuguccucauuuccccaccagggucucuagcuccgaggagcucccguagagggccugggcucagggcagggcggcugaguuuccccacccauguggggacccuuggguagucgcuugauuggguagcccugaggaggccgagaugcgaugggccacgggccguuuccaaacacagagucaggcacguggaaggcccaggaauccccuucccucgaggcaggagugggagaacggagagcugggccccgauuucacggcagccaggcugcagugggcgaggcuguggugguccacguggcgcugggggcggggucugauucaaauccgcuggggcucggccuuccuggcccgugcuggccgcgccuccacacgggcuugggguggacgccccgaccucuagcagguggcuauuucucccuuuggaagagagccccucacccaugcuagguguuucccuccugggucaggagcguggccguguggcaaccccgggaccuuaggcuuauuuauuuguuuaaaaacauucugggccuggcuuccguuguugcuaaauggggaaaagacaucccaccucagcagaguuacugagaggcugaaaccggggugcuggcuugacuggugugaucucaggucauuccagaaguggcucaggaagucagugagaccagguacauggggggcucaggcagugggugagaugagguacacggggggcucaggcagugggugaggccagguacauggggggcucaggcacugggugagaugagguacacggggggcucaggcagagggucagaccagguacacgggggcucugaucacacgcacauaugagcacaugugcacaugugcuguuucaugguagccaggucugugcacaccugccccaaagucccaggaagcugagaggccaaagauggaggcugacagggcuggcgcgguggcucacaccuguagucccagcacuuugggaggccgaggcgagaggaucccuugagcccaggaguuuaagaccagccugagcaacauaguagaaccccaucucuaugaaaaauaaaaacaaaaauuagcugagcaugguggugugcgccuguaguuccaauacuugggaggcugaagugggaggaucacuugagcccaggagguggaagcugcagugagcugagauugcaccacuguacugcagccugggugacagagugagagcccaucucaacaacaacaaagaagacugacaaaugcaguuucuuggaaagaaacauuuaguaggaacuuaaccuacacacagaagccaagucggugucucggugucagugagaugagaugauggguccucacaccaucaccccagacccaggguuuaugcaccacaggggcggguggcucagaagggaugcgcaggacguugauauacgaugacaucaagguugucugacgaagggcaggauucaugauaaguaccugcugguacacaaggaacaauggauaaacuggaaaccuuagaggccuucccggaacaggggcuaaucagaagccagcauggggggcuggcauccaggauggagcugcuucagccuccacaugcguguucauacagauggugcacagaaacgcaguguaccugugcacacacagacacgcagcuacucgcacacacaagcacacacacagacaugcaugcaugcauccgugugugugcaccugugcccaugaggaaacccaugcaugugcauucaugcacgcacacaggcaccggugggcccaugcccacacccacgagcaccgucugauuaggaggccuuuccucugacgcuguccgccauccucucagguuucacgcaugugugcugcagcucccauuucaucagcaaguuuggaagaaccccacauuuuuccugcgcgucaucucugacacggccucccucugcuacuccauccugaaagccaagaacgcagguaugugcaggugccuggccucaguggcagcagugccugccugcugguguuagugugucaggagacugagugaaucugggcuuaggaaguucuuaccccuuuucgcaucaggaagugguuuaacccaaccacugucaggcucgucugcccgcccucucguggggugagcagagcaccugauggaagggacaggagcugucugggagcugccauccuucccaccuugcucugccuggggaagcgcuggggggccuggucucuccuguuugccccauggugggauuuggggggccuggccucuccuguuugcccuguggugggauugggcugucucccguccauggcacuuagggcccuugugcaaacccaggccaagggcuuaggaggaggccaggcccaggcuaccccaccccucucaggagcagaggccgcguaucaccacgacagagccccgcgccguccucugcuucccagucaccguccucugccccuggacacuuuguccagcaucagggagguuucugauccgucugaaauucaagccaugucgaaccugcgguccugagcuuaacagcuucuacuuucuguucuuucuguguuguggaaauuucaccuggagaagccgaagaaaacauuucugucgugacuccugcggugcuugggucgggacagccagagauggagccaccccgcagaccgucgggugugggcagcuuuccggugucuccugggaggggagcugggcugggccugugacuccucagccucuguuuucccccagggaugucgcugggggccaagggcgccgccggcccucugcccuccgaggccgugcaguggcugugccaccaagcauuccugcucaagcugacucgacaccgugucaccuacgugccacuccuggggucacucaggacaggcaaguguggguggaggccagugcgggccccaccugcccaggggucauccuugaacgcccuguguggggcgagcagccucagaugcugcugaagugcagacgcccccgggccugacccugggggccuggagccacgcuggcagcccuaugugauuaaacgcugguguccccaggccacggagccuggcaggguccacaacuucuugaaccccugcuucccaucucaggggcgauggcuccccacgcuugggagccuucugaccccugaccuguguccucucacagccucuucccuggcugcugcccugagcuccugggguccugagcaaguucucuccccgccccgccgcuccagcgucacugggcugccugucugcucgccccgguggaggggugucugucccuucacugagguucccaccagccagggccacgaggugcaggcccugccugcccggccacccacacguccuaggaggguuggaggaugccaccucuggccucuucuggaacggagucugauuuuggccccgcagcccagacgcagcugagucggaagcucccggggacgacgcugacugcccuggaggccgcagccaacccggcacugcccucagacuucaagaccauccuggacugauggccacccgcccacagccaggccgagagcagacaccagcagcccugucacgccgggcucuacgucccagggagggaggggcggcccacacccaggcccgcaccgcugggagucugaggccugagugaguguuuggccgaggccugcauguccggcugaaggcugaguguccggcugaggccugagcgaguguccagccaagggcugaguguccagcacaccugccgucuucacuuccccacaggcuggcgcucggcuccaccccagggccagcuuuuccucaccaggagcccggcuuccacuccccacauaggaauaguccauccccagauucgccauuguucaccccucgcccugcccuccuuugccuuccacccccaccauccagguggagacccugagaaggacccugggagcucugggaauuuggagugaccaaaggugugcccuguacacaggcgaggacccugcaccuggaugggggucccugugggucaaauuggggggaggugcugugggaguaaaauacugaauauaugaguuuuucaguuuugaa

SEQ ID NO: 192438 - RNA, 28825 nt, Homo sapiens
acgggggaggaguuccgggcacgcggacggggguccugggcaccgggcgagguccuggccacgagggagggguucugggcacgcgggaggggguccugggauuucgggcagggaaccgggcacacgugagggguccuggguaggcgcuuacguuccugguagaggguucuggguucgaggcugcaagcccacucaccccgguccuggagacuagggaagcaucugugcuggcuuuuguguggagcucagggagaagcugggcugcccuuucucccgccuuucccucccucucccuugcucccgcagcagcuccaugggugucagcgggcagcacgggcgccugcaggaagucaggcgagggugaaccgaagugcuggggguuucuaggagggagaucgggcuccgggguuccaggucccucuuaauccaucuucuugaacgaguaaugugaacaacaucccacagggccucuggugaggacaccguggcucgaaagggaccugaagcucccugcggaggggaagggagaacaaggaggcagugacaugccgccacuguggucuucccuuccgucuuucccugcugguuggcagccccgcuguacuccuuagggaggccuuucccucuuagcaccuucacgucucaccuggcugcguggcguuugcaccugagcacgcggguagaacucggucugugucugugcagauuaugccgacaagccccuggagaagccucuaaagcuaguccugaaggucggaggaagugaagugacugaacucucaggauccggccacgacuccaguuacuaugaugacaggucagaccaugagcgagagaggcacaaagaaaagaaaaagaagaagaagaagaaguccgagaaggagaagcaucuggacgaugaggaaagaaggaagcgaaagguaaaggagcagcggcgguggcccggacgcugcccacgaggagcccguggggagccuggucccaggacccaggcagagugcgccugcguggcuggaggaggggaggggguguuccguugguagcaaaacgcgaaccgcugaggcccgcagacucaguuccaggauccugggugugcuguuccucagcagacccugccagggucucugugaggagggagccuggcaugaggaggaucucggaggggguuucccuuaguucugucccuccccugagaacugcgaggggauugggcagaccuguccggaucccgccuacuccugccuuucucacucccuugacucugccgcccaggaagagaagaagcggaagcgagagagggagcacugugacacggagggagaggcugacgacuuugauccugggaagaagguggagguggagccgcccccagaucggccaguccgagcgugccggacacagccaggcaagggugcacuuuuagagacucuccugguguucacagcucaucguuguaaaugaggggucggcaccguguccuguugcuuuggggagaagcaugggagggaggagagcugguauuuccagggccucaucccagguguccucuggccugagguuuccuccggugucucugaaugucuagagcaaggcguggccaguuaccacuggugcccuucaguuuuguuuuuuaacuuguuagcuaaggauggcuuauauguuuuuuaagcguucauaaaaagaaacaaaaaggcaucuccacagagaccaaucguaugugacccgcaaagccuagacuguuuuuugucuggccuuuauguaaaaaguuugccagcccugggucuugaaguuugguuuuguuugcacuuaagacaguauuggaacaguagccccaucugggucagacugguaagagagaugcaugucagugaaaacgcagguaauuccccuugggaagaagggaccucgaggcccaaauggugggucugaaguugcugaaagugaccauaggcugagacaaaggaagcuggaggccuuuaguagaaucucugucgugggcaccaucugcgaaggauggcauuuggcuggaauuuccaguugacaaggacuugcccucugaguucucuuuguccccagccuuccugugcacaacucacagugaugaggcauuuguaccuaagacaaggggugucucuucccagcaacucucagcauccagugguuccuggauuauagggaaacagacggcugggcuuugggacaugggacaucagggaguggggaggcuagugcugcgaucauucaggccgucagaaacugucugaggccugcuggcuccacugaaggaaaguucuggaaagcugguggccuucugagcuccuguggucauuuggcucuucaggcacuuucuuuuuuuaauuuauuuuugaaacauggucuugcugugucgccuaggcuggagugcagugucgugauucacuccugggcucagauaacccugggcucaagcgauccucccaccucagccucccaaguugcugggacuacaggcacgcaccaccacgccggccauuuauuuacuuuuuguugaauuuuaagggaccucaagugaaauaauaaucggugaauucaggaucaaccuuuauguccagagcguuuguuccgucguccauuucuugucuagaguagugguaugagcugaaaacauugcuaagugaucaccacauauuguugauguaagggcuaccgguuauuacaagagauuuuuaugacuccugcugugggggugcccuuucuacccggcugagcuuggugggagccaaggcugagucggauguaucuuuauauccccaguucucgguggaacuuaaaaugcugugagacaccagacagacagauacugugaacuuggagcucucuaaugaagggauaccaaagucuuguauucaauuuuuuuuuccuuaaauugucagccgaaaaugagagcacaccuauucagcaacuccuggaacacuuccuccgccagcuucagagguaaaccggggcguuucugaagagcuagugucuggggggguguggugucaucuuuucugaggccuuauuccccacgccagccucgucagcugugaaacagacccugcaccuucucuuggugacucccaguccacuucggggugcguaggaagaguucaugaacucauuaguggcucacucugaagucagaguagagugagggaagucaaggcuagagcugggacauugauggccgccaggaugcguugggggaauuuuuauuauaucugaaauaccuaucacaauaaauuaaaagacgcucguaacuuuuuuauuuuuaagaaacaaaauucggucaguuguauccaauuuuuggauuguaagagauuuuguaucauuuagaaaucuagauuuuuccgcuuuaagaugucuuugcuuucagaaaagauccccauggauuuuuugcuuuuccugucacggaugcaauugcuccuggauauucaaugauaauaaaacaucccauggauuuuggcaccaugaaagacaaaauuguagcuaaugaauacaagucaguuacggaauuuaagguaaguuacuuucauugcccgaaguaaucguggcauaguucuguguauucaugucuugugaagacuucauucaccuuagaucauuucuaguuuuugagcuuucacagguguuucuguguucggaugauguuuuacagacacagcauuaaggaaaugauuggucgugaacguuuucucugugcuuuggucuagaaacuaggucagguugcacgcuguuagaagucuguuucuuuucuuucuaaguuacugcgcuggcguaaauaggacauguuguuucaagcagugagguguccgguguggcacggcuugagacuagacauuuuuaaaaacauacuucuuuuuaauucuuaguuuugucuuacacuaauugagcauuuaguuuuuuuagcauaguaaguuuuucugucuccugaguacuuugcucuuagcucuguuucuugcuacuggcugugagaauuagcaacugcucauugguuuugcaacccaggggaagaaagcaaaacaaaugcuugauaaaguuggcauuaguguaguuuagaaaggcauuagauuucucucuuagguuccauuccccuggggaaagcuugacuuuucuauuuuaugcuuacugaaggguuugcugacucacagaaacacaacagaacagacuuaaaggagagugggagaaaaggaaacucgaugagaggaucaggcagcgccugaggguagauguuaagagcacuccaugcccgaaagcccucuguauucccugcuucgggccccagucuggccauuccuagcaacaaagugagaaggggagcagcauucacuccguggaguguccgcaguggagucuucaggggaggggcuccacagccucgggccgggcccuagggcugcuggcucuggaaccgggacuuggggaggguccagauggcacguucucaguuaggguggccggccuccggggucaugcuccagccugacguugguacucaccuuugagaggccugugcugaggaaacuggccucucauaauaaaauacugaugcuuccguauuuucaccauaaauuacaaaauaagguuguccuuuuguggggcaaagucuuuuucuaguaguuugagggaaccauuuggugacagaauuuuaaauucgauucuguggagaaauucuagagauagaggcuaucacugugccgcacgccugccuucaucccuugacuugcacuugaaagaaucgggucguugcuucucguuccuguuuauguucuggagaaaugcaagaagcgcaggaaacgcuuuuuccucacacagcauuuguaugugaugcuuagaaagaaguuacaggcuuggccaacuguuugcuguaauauuuuucaugcaagaccaaugugcaacuaagaaaacuucucuuaaguucuuaaacguuauguuuagaucagagagcccaguugaauuguuuucuacucgauuguagcuuuuuccuuuuggucucuugguagucaucuagagcuuugcuguugucuguggcauuucaaaccugauaagucuuuccuguuuucuuuucaggcagauuucaagcugaugugugauaaugcaaugacauacaauaggccagauaccguguacuacaaguuggcgaagaagauccuucacgcaggcuuuaagaugaugagcaaaguaagaaacucacuggcagcagcgagcuacggaaagcaggggcucugccccccgucgcuugugcccgaagggagccucacagugaacacgugcuccauccacccgccacccucaugguguugcccccuuugcucuaggguagacguccccggccgcccucucugcucaugaccuagcuguaacaucucauugaggguugguggaaaguuccgcaucucuugaucuuaagccugggugucaggugucagucuugcuggauggcagccagcauugcgggcuuguuuugcgugacugccucacugaauccagacgggacauccuugucuuccuuggccauccugaguggcuucccagaucugugccgugagccaggcugcaugcaucccacguaggagaagguaaaggggaggugcggcaccugccgcgcucuggcggugggucaagcccccacaaccaccucccgcugcuccgccguggaaaguuagcucuuaggccaggugaggcugugaccauccccaucccaucccaucgucacggcacccuggcugugagggagagguaaaucccugcugcucuguccuuucugauucuaggagcggcuguuagcuuugaagcgcagcaugucguuuaugcaggacauggauuuuucucagcaggcagcucuuuugggcaaugaagauacagcuguugaggaaccugucccugaaguuguaccaguacaaguagaaacugccaagaaauccaaaaagccgaguagagaaguuaucagguaaagguucuguggaaaccacauuugcuuuuggaguugagcaccauagccaggaaagcaggugccuuguaggggagagugagugagugagagaacggaugucaugucacauagacauucuugguguagcuuauucuggcaggaggaguguggccagacagccccuccugcccaccggccacgugcacucucugacccaggugugguacccaagcccguccgaucaccccugcccccaacugcuagugacugguggucucugucucuacacgccguuaagaucauuggccccucccuccccugcacagcgccugccggcagccaaggcugugcccuugucccagacugugccgcacaagcgggcugacuuugggcagccagcauuggcagggggcuucuuuguugcuguggggcagaugcacacuccugaacugcucgcuucugugucuguguagacgcuggaguggagcaggugcaggccuguggucaggaagguguggaugcugcgggggaagcaggugaggacugcaggccacagcucccuguagcucugcucccucccacagggagcagccgacuuggcugguccuucagggaaccuucuuccuuuuuuucuaaaccccagagugguuuucaugggggcucuuugucucaugguggcugagcauugagauuguaucaaaguccguaucacacgucauuccuguagacgcuccuccaccuaugugagguggcugccugauaggaccaaacaaagcgagaguaucgccaggggccuuagaggcaccaagagcacuuaacauagccugcagcgggcagaagcgccuggcacagagccugcuucaucacgugucacuugcugagugcaggccccagagagcgcagucucaggacauccacccucauggccgugugucugacagcacuguggcucgcggucuucccaguauccugagaggacuggccuguugccauccuggggacagaucagauuugaaggaugguuucugcugaaguguauugcuuuugugccaucuugugggaagucagggaccgucuggaguugguacugaacguccuugaggcaauugugauggucacggcccuccauuguuuguuuccuucucacauguguaugggacucacguggauuuaacagguggggcggcagcggugcugggcucggugcuucugcucugagcagcucccuccaaccgucaaaagggagaguggucuugagaccagccccucagguccugcagccuuggcuuaggagacagggugcgcugcguggccagaguguguugcuuggcaacggacgacaguccccuaaggcggucuccccacgugcguugcauuucccaccccgcugccgugugaacacucacugcgugguuggcugguggcuguguccggccucagcccccgacucgagugugcugcuggccuucaggggucgggguuucauggccgcccuuugccgccucauggugacugagcaucgagggggaauugaaguuggugcuggucagcaugcucagcugcggugggguuguguccuggcagacccaccccagguugguuuugggugucucuggugcugcagcuucacccuugccugugggauccaggcccuuuagauggauccccagcugucagucugcaggcaggagagcgugccgagcucaggcagucaccuucaccuagugucacagcagugcgcaucgguaaugggcucacgcaggugccugaguggagccccucccugcggagcucauggggcugugacuccuguguaggguugccagguugucacuguaggucaggcaagggcagggccgcucucaugggcagggcuuguccugggccugcaccuggcccuaggccacucagacccaugcccaggcaagugcccagggugggaaggagcccacucgcuugcuucuagaaccuuccacacuccuugggugcuacagccugugccccucagcuguuggagaacugcuucagguggaaccugggaccacuugcugacguccuuguguguucuuugugccacccaguggccacagcagagggggcugcuguccacccagcccagcagcaccagaccacacccgagcagccccgccuauccugccuugcugugaacccugcguagucagggguggcuuuuccagucacuuuucugauggggccuuuaauaacuaaccagugugggcaucuguuacuuuguugcuuuuguugcuaaagcacuuuaacugaguuugcacugcguugaaaaauaggaagucugucuacuuggcuuacacuuacccuuuauuuuaauaaaagugucuuaauuugucauuugguuagggugaaaagggaugcuuugagaccuaaaaggaguuaaguaugcucugccagcucugugucugagggcagggucgguagaagcuggguuaggugccgacgcauggggagcaggugugcgguggggacgcugccuccaggugacuugguuguccccaccucacagcugcauguuugagccugaagggaaugccugcagcuugacggacaguaccgcagaggagcacgugcuggcgcugguggagcacgcagcugacgaagcucgggacaggaucaaccgguuccucccaggcggcaagguagugcucuguggccaccgagagagggugccacguggccccagacucucugugugccucuccuucuggguuggugcugugugaucuagcacagccaccgggauccagaggucagcguggggcccugacgggagguccggaucagacacacauaaggcuggucucuucagucgggguccaggugccucuggcagggcugccgcugguguuucaugcaucguggaggccacguggucacugaccucauuuccuugauggaggcccugcugcaggcuaauccuuucucuuggagugaaugcugacuucugugucucugucacuggguguugacgugaggcaccgcccuuguuauuccagugggggugcugguguuggauccgacagaugguccauaauaggccaccgacuguguucacguggcuccugccacagauggucuuuguggugguggggcccacucagcugaccacgcucuccuuucuggcaggagacguucuagacccagugucuucaguggaaacagagcacaggcugucugcagucucaggcuuccuagcagcccugauaagagaaguagagcaaugcaggugacauuaauccuugcagguuucauuucaccucuauauccaacauuuuaucucaacauguagucuguagaaaacguuaauuugagcuuuauggguuuuuuucauauuaagucuucaaaaugcacaugggaugggauguaaagaacgcugaagugggggcauuucagaggugucugcugcuuuuugccugugccugcugggaaguugcagugcucuguguggcuugcguguugcgagguugcggucugcguggcucacguguugggaggucguggucugcguggcucacguguugggaaguugcaguggucuguauggcuugcguguugggagguugcagucuguguggcccguguguugggagguuguggucugcguggcuuguguguugggagguugugguucacguggcuugcauguugggaaguugcuguggucugcguggcuuauguguugggagguugugguuuguguggcuuguguguugggagguugcagucugcguggcucguguguugggaaguugcuguggucucuggcuuauguguugggaaguugcugugguuugcguggcucguguguugggagguugcaguuugcguggcuugcguguugggaaguugcuguggucuguguggcuuauguguugggagguuguggguuuguguggcucaaguguugggagguuguggucugcguggcucacguguggggcgguugcuuggcucgccuguugggaguuugugguuugcauggcuuguguguuggaaaguugcuguggucuguguggcuuaucuguugggagguugugguuuuuguggcuugcguguugggggguuguggucuguguggcucacguguugggagguuguggucugcguggcucacguguugggcaguugucugcuuggcucacguguugggaaguuguggucugcguggcucauguguugggaaguuguuuauguggcuugugugcuggagguuguggccugcguggcucacguguugggcgguugucugcuuggcucauguguugggaaguuguggucugcguggcuuguguguugggaaguuguuuauguggcuugugugcuggagguuguggucuacguggcuugcacuguaguucuuuuggacagccuuguucugcagucuguguuucagcccuggaauugccacauucuccaagaagcccugguuucuugacuagagagccuuguguagaagccaggaccuggguucugggugaagcccucugcagauagagcugggagaugccuguugugugugucugcaccacauacauggacacugugcagagggauucuguuggcaccuguguuuacauggguugaaaacuguuuuuacacggaaacuuccaguucccucgugccccguggguuccgcccacuucuucccuuucaguuuuguaucugcgccgugaggacuugucuccuaaucuucguaucaacuccgugucccauugagcugaccuuccgccucucccccagggcccuggccauccugugggcucugagacuuugcauggauccgcgguggggagcugcccccacacaaacguccggcucuucucaggccagguggcugcccugacauggcaugauguccagcgcauggacgucacccuugcacuggagcccagccaaccgcugcaugacagcccucuucccccuugaaccccaagucugcacacaccagugccuccucuuccuggauccuccugauggccuguacacagaacuggggugugggugguggguuuuuaaaugaaaaccaguccacacaugcuugagggcuggagccgccugccgucagggcagugccaugcugaccugcugaccguuccauuuugucaaggcucaugagcaauuuuaaauguuuacucgugggugaagguuuuuguuucagcuguacccccuauagcagggccauggggagccuaagagguucuccuuggcaccugugcgcgcucugcuguugccggugagucugaaauuccagggaaugccgugaggggcccucuggcguuuguucuuggacaaaugugcuuucacccccauuaagcccugcuuguuggucuucauuucauuugugcugcgcugccccuccugagggacagacgcucaggcagugcuuccuuccagaugggcuaucugaagaggaacggggacgggagccugcucuacagcguggucaacacggccgagccggacgcugauggugggugcccgcucagggcuggcuuuaugcucuccguacacugcuuuuugggccuccguugauauucuguaaugaaaagcugagccauggccauggggcagcaugagaggcugcccggcuucccgaccuugcucgcaccccaacgugacacgugcgcugaguggagguguggacggccaucucgcggggcgggggugcuggucagaccucggucagggcuccuugggagcagcgggacucgagccauguuccugaaaagcugccgagaggccuuuaaggccaaaccucacuagcaucaggaaggguucacaucccgagcucagucuucagcaaagaccagagugcuggcccacccugcuccuugaaucuggaaagcagucuuagaagagcuguuagaugaugacgucaggacaguguugaaggauggugcacacuaggccuguccagcccgucaggggcacuuuguuggccuggaaguaauuaagaggcuuguccuuugaacgaaagugugaucacuuggguuugaaacgcacucgcgggcucgcgugaggaacgugcagccuggcacggguugccucuagauuccugcuucccucgcucucacccucaugccugcugguggucuuucacccagcuccaccaugccagcgugguuuucuccagugugugaaggauagaaacgggcugaucuauauaaucuucagcuuauuuuccuaaagaggauggaccguugauccauauuuagcuuaugagaguguugagaccgaggcagcgguugggaacugaggaacuccugcucugaucccaugagugguguguggguggugacuugagcauggcagacaugcugucagaugcacgcgcuccagguacacgccaccguuucgcuguuagaacacgcaggacaagauuucuucuuggaguuguugagugauccauuugaaaauguucucaaaguauugcuggugugguggccaaagaugugguauuuuuuauuguguugacuuuggggugauaaagaaaugaaauugaaaugcaguuaguuuugagaaugguaguuggcuuuugcaaauuuguuuucaggugaucauuauaaaauccccccaccugcaccaaucacauccacugugauguggagaaagggcucauggcacugcacuggggcaccgcguuggggucacaccugccacucacggcccgccauguccguguugcagaggaggagacccacccgguggacuugagcucgcucuccaguaagcuacucccaggcuucaccacgcugggcuucaaagacgagagaagaaacaaagguaaauccauagucccgucccaggagccagccggagcagggaagguggcagggguuuaguggagugauggcaaaugcugcugauucguacuucagaguuuccucacuguaccuggauucauguuuucacauggguaagauugagaucaguuacagugacaggaaugaaacucguguuggauggggacacacacagcgggcaccuugguugcaucacuggacuucaccuuggucaguguuuugggguccuuguguuucugucccugucgcauuacagaacaucccuucaggggucagaauguguggccccugggccuugggucuggccuguguguucucuccaucugcacugcugccuccuggcugcgcugcugcugggaccuccugcauggccccacccuccacuucuccaccucugcugggucccucccaugcagacagcugcauggacacugcuccugccggcccuuucugccucagccacucacaccaucugcuaaugggacagcucacucuucccuccaaaccauggccuuggcucaagagcuuccuuguuucuggaauguucuuuccuccagcuccagguguugaaauucugccuggucugggucuccuguugaaggacgcccuccacugggaaggauccucuugccuucaccacuugucuucaccagccccugcuccccucuuccucuuggggcuguugugguuguugauacuuuuuuuuuguuguguuugacacacaucuucuucucacccucuaacacaguucucaaccacagcacuuuugucccuggagauguuggcaguguccagaggcguguugauggucccacugggguugggggugcugcuggcaccagaugguagggagaugccaggggugcugcuccacacccuaugggacacugcacaguacaccuggccugugucccccacagcgagagcuggcccugggcaggcguggucccugcgguguguguugguugggauccuccacagugacagacggugcgcucugcccacguuuccacacagcucuuuugcuuguggagcucaccccuuugcagagagcucauuucccugcggucuuuggccugcagaaguaaaaugagggguggugaauuacaccccugcugguuacacauggaaaacucaggagugagaauuuuguggagagcaagagaggugagacuggggugcuggcugccagccaggcggucccucagccccuggagaagcgggguggggccugcacaccgaguccuuccagugaguccagugaugcucucuccucuuccucccagucaccuuucucuccagugccacuacugcgcuuucgaugcagaauaauucaguauuuggcgacuugaagucggacgagauggagcugcucuacucagccuacggagaugagacaggcgugcagugugcgcugaggcaagugucggccccggggagcccuuggcugcugugcagcuugagcugugcccuggugugggacguggagucccacaugugugcggguggggagagagccaucuugcagccguccauauggcagccugggucuucccguugcuuucagucauccacacaggucugccacaggccaguccugaaaucuggguaacucagucagaagguggugaucagggcguagcuugugaagggguuggggguguguugagcacacuggaucguauugaauuguguuuccuaagugaccgugcuagcucaggcugcagugacaaagcaccacagacuggggucuuauuccugggggcuggcauuugccaugaaggugugggcagggcugguuccucccgagcccucucuccugggccugcaggugccgucuuuccgucuuuucccugugccuucccggggccauccugcgugugucuguguccucggcucuccuggagacccuaccguucucaaggacccuggucauauuggaucagggccacccuaauggccucaugucacugcaguuaccucuaaaggccguuaaaguccccagcuccaaguauaaucacauuccaaggcacuggggucgggauuucaacuuacgaacucugagcgggagauacaauucaggccauggcaggcuaaaguauaauacuaaaaucacaaauguagcagccugcuuuuccguagaauguugcuguguguauuuuuuguuuucuguggcaaaauaaaagugggucacucuuguaaaauuuggcaguuuuuaauggagaaagcaacuuaauuuugcuagccuuuaagaaauggcaucuugacauaucaggucuucauuuuauuccaacaagaaugcagaauauguuuuaaaaauaaacaagaauccccuuagugcuucauaaaauaagugaaaaccugacccugauuuuuguagcaaaaaaugaaguaaacguggaaaaugaagaggaaauucuaguaggagacgauggggucauaagucagaaauuaaagaguuguuugcuccccacccucccgccagcccucaccucaccccugcuguggggccucugcccagccugggccaaggccguggcuccccuggugccauccuguccgcagucggcucccuguccacggcguguggcuccuucaggacaucagucaccuguuguccauguggcacaucaguggacugugcacaccccccgccuuccccagcugucugucccuagaacgcaucagguuccauguugccgugaagaaagaucauucugaccccgccugccuuguggcugcaggggcaacacucagaagcacaucuccuagggccuggcaugaggcuacguggucccaugccagccucagcgcacagacacccagauccucugccccugagugcugcuuccgugcacgcugcgagugccgagcuuggccugucccgggcuguggguguuuuaacaaagacacggagucucccuguugccuccugugaccgugguucagcuucugaccagcagccauccuuguuccucucugugaaggucuuuggagucuggggagcccuucugaggcgcuugcuuggugcuuugauucuaagacuaugcauuuuuguuccuggccuacuuuuuagauuguauuauauuuuauuuuuuaagcuguuucauguauauggccaagaaucaggaugguacuaaaaggagugccuuggaagugucggcccaccccugccccacgcgcccauuccucaccggcaggcacugcccacuggugugcuucuguccacacccacuuguguuuuuaaacgcauaacgaguggaaagauaggaguauucuuuuacagaugauaacauagcacacguguguuucuaggcugugugcauguguauucaugcuuuucucccucuccccacugagaucuuuuuaaccuuuuugggucauggaccacuuugaaaaucuaaugaaaacuaucagccacuccccacaaaauacccgcucugggagggucacggggaccgaggagcugcgcuggcacggcaggcuucugugaucagggcugccgcgagggccaggcgacaagggcuccuuucagcguaccuucucccgcggccccucuagccugcaggaguuugugaaggaugcugggagcuacagcaagaaagugguggacgaccuccuggaccagaucacaggcggagaccacucuaggacgcucuuccagcugaagcaggugggcugcacucgcaccgggguuggggggcaggugcccuuggggugcugcuggcgggaagagccugcagccugaccaggcuuucggggacgaggagcugucgcagggacucugcugccggcuccucgucaggaucugcgugcuucucugcacgggcaggugucccccggagaccgugacugugugcucaccacucccagcgcacucguaacucucuauuuccaucuucaucuuucaucucugucacuuuccuucauccugaagaguuuaaaaaaauauuuccuguaguucagauuuacugacagugaucucucagcauuggcuucucugaaagucuuuauuucaucuucauuuuugaaauucauuuucccuguguauggaauuuuagaugaccuuuuuucccaucuacuguaaaauagguuugacuugcauuguugcuauaaaaaagcaucugggccaagcaugguggcucacacuuguaaucccagcacuuugggaggccgaggcgggcagauccaaggucaggaggucgagaccauccuggcuaacacggugaaaccccgucucuacuaaaaaauagaaaaaauuagcugggcgugguggcaggugcuuguagucccagcuacucgggaggcugaggcaggagaauggcaugaacccgggaggcagagcuugcagugagccgagaucaugccacugcacuccagcuugggccacagagccagaccccaucuccaaaaaaaaaaaaaaagcgucugaagucauugucaucuuuguuucccacaugugacgugucuuuucggccagaucugaccugaagucugcuuuuguacagaccacaagccaggaaugucuuuuacaucuuuaaaaggguguuuacagaaaagaaaaggaagaagaagaugcuucgggcagcguguggcucacagagccucggcugcucacucccgggcccucggcaggacgggaucuggccggugcucuaggagcuuuugaacuuuuaucuuucuuuaucagugauuuucagcauuguauuuuccaggugccuuggugggcuuuucuuuguguucuacuuagcauuuguuguuucuuggaucugucuguaguuuucaucauauuuggaagauuuuuagccauuacucaaaugucauuuuccaccacugccucuuccuccuccugcuggacuguggcacucugaggacagcucguguuaucucacauggcaccgacacugugcugccgcaccaggcugcugcagauuaguuucugaugcuguuggcuaaguucacucaccuguucucuggccacaccugaaccuguuaucccagaucaguuuucacugaugaugucgucccgcgcugcucaucacuugggcuccauuugcugcuuuuguguaucuucucucauguuguguguauguuuuuccuuacauccuugagccacguucguauuuauugcugcugcuuuugaaguccucagucacugagucugucgccucugccguuuccgguucuguuucuguuugacacuuugcugcacuuggagcugugggccauugugcacgugccugguggacaguccugacccucgcugucugauaaaaaagcacuggccacauggccgcugggaaauuugaauguggccagucugaauuuagaugugaugugugagcuacaaacuagaucuuaaaaaacuaaugcaaaaaacguaaaaauaugaguaacgauuucuuauggcccacauguuggaauaaaaacaucuucaauaaauuugucuaaguaaaaugcauuaguuaauugaauguuaagaguaauuuuaauguggcagcuagaauuuuaagagcuggguaugguggcaugcaccugucaucagcuccacaggaggcuaaggugggaggaucacuugaggccgggaggucgaggcugcagugcgauugcaccaccgcacucuaggcaauagagcaagacccugucucaaaaaaaagauaaaaaaacauuuagaacgaggcgugugcucgcguuaugucugcugggcaaggcugaucuggguucuuucucucuuucagagaauacugaugaucauuuuggcaguuguuacuuguggauaauggccggauccuaccaggcuugucugggguggguccagggcagccuuauucuaggguucguguagccuuaaugcuaaggaguggcccuucggggagcccugucuuuucagcguggucucugcuguggguggaguucggaugagucucuguccuucccaggcucugagaacguuuggcucauggcucccaaggaggggucagucccuugaccugacgguuucaucugugcuuguuacagaugaacugggguccacaugccuggugcaguaaacccagacacccaugccgagguuuugucauagaaaggacguguguauuugcagggcgccaagcaaggugggccaggaggcucauguauaaauccuggccucccccacuggcuacaggcaaggcuuguaaagcggggguagaucucaggaaagcagaacugaaaggcagagucgugcauaaggacacagagguuacaugucggcuuggccuagaagggcgguaucugcaagcagggccuuauagguuauagguggauucaaagguuuucugauuugcagcugguuaaggaggagaagcuuuguuuaaaaauuuggggugaagagaaaagaauguuagcuuaggcuuguggguguggcuuccuccaggcccgucaggaagaaauucagaacaaagaacggggucagagcucagucuucaguuucuccuuaucugagcccuucaugccaguagauuaguuuguuggggagguccuagguggaggguccagguuucugaaagacaacucagggauauacauuaagauguuaucuuuacuuucuuucuuuuuuuuucuuuuugagacauagagucucacucugucacccaggcuggagugcaguggcgugauuguggcucacugcaaccucugccucccugauucuagcgauucuccugccucagccucccgaguagcugggauuacaggcaugcgccaccacaccuggcuaauuuuuguauuuuuaguagaggcggaguuucgccauguuggccaggcuggucuuuaacuccugaccucaaaugaugcauccaucucagccucccagagugguaggauguugucuuuucuuucuacagggaacagugcugggagguugucuuuacuuucuacagggaacaaacaucugucuccaccuuccuugacuguuguuuuaggauacuguuaccuucuugcuuaucaagucgcugauuuacuucucagaguuaucuaaguaacuggaauuucccuugaaggaacucaagauuuuccuugauuuccaugcuuggagggcucgcaggccccugaagagaggguugcagccaggcgggaguccccaagcagauuucugcagcucugaggagcagcccccucugcagagccugccccaccagcucgugguucugacucugagcucuggucacccucccgugucguggccugcaggcuccuuccaggcaggaagcuggcccccccaacacagcguuagaaucaggcauugcugugggguagggaaagugacccccucacagcccggaaaugggaaggcucugugguuuccucucuggguuccaguuagauuccuuucgggaaagugaacuuggauauggaguugagugaccccgagugcacccccgcaguaaaugaugcucaggacuaaagugacugaaggcuuuuggggaaacagaugcgaacaaaacagcaguauucauuuucuaauuaaaagcuugugaaaaucgaugucauugaaucugagaaacauuauuucgaacaaagaucacacaugauagagugcauauacuacagcaucgcuccaccggagcacaggacgggugugccacggaggccgacaguuguggaaggagacaaugcacggcccggcccaccugcugcaggcaccgccaggaggugucugccuccuucgcuccugcgcccacggcaggcccaccugccacaggcacugccaggaggugucugccuccuuugcuccugcacacaccugccccugcaggacucgagcuggucucaggcaacuggucauauuccagguggaacccacgagacccuucuuauccuaagcuucccauaggaucuaggcacaucuuuuuucuuuuguuuuaagccacccaaggcugccgaaacagcaucggcguccucucucuguccgcuccaucucgcccuguggagcgcuguccccggcacacaauccuggcgcugaggagggggcugggcgugguugggucagugacuggugaugaagaagguuuggaggacccccagccuuaauccauuaagauggugugacuggggagcagaauucgcagaagcgcacaagccauuuuuacguguguguaaugucagcgaauuguccguuucuaugaaaucacucuggaaaaacuaguuucuguccucauuuacuuuucagagaagaaauguucccaugaagccuccagaugaagccaagguaaguuuuugaacauggaagggcaagccaaauauuauucucacagggaaaguuguauccagccuuugagguggggaggucuguguguaugacggcguuuagaaauggaguccguuucugaucaguaagaucaauaguguuucuccuccucuuuucaugacuugaggugaguggugugaagccgcaguacauucuuccaaauccagaaauggguaguuucagagcaguuggccccgcugggugcuguccuugugggacacccuugcaaggguugggcaggaugggccuucucaggaccugcuuggugaguagcagguguugucccaagcacagugggcucuggggccagugcuggcagggcagugcugugagcccagacugcugcaccugccgauuggcaggugugugucucugacagucagcaggcaugggcuugggcuuugguccagggucccugggaaccuggagagaccccuuaacaucuguuugagggcagaggccgagcugcagggagcugaugagagaguauguguuaggguggcuguagucuagcccugaggacacgccuugcugggaaaggaaagggaacguugugugcucugugaagugccugagaaauaguccuggacccuaaaauucugugugucuuccuguugcauaaugucccuccccaauuucuuuagccccaaaaaguuaacaaaggauuguuaguuugcguuguuggucucaguagguuuuucuuugacauggauuugcauauccauucaugagcuccaaccugacagucccuugaacagcagccucagugaacagggcuuggucuugucacuuacugagggguggguucacguuuagcaaauaauuagagugauuucaauagcgagugugaaguaacauuucguuuuucguuugauguuugaauugcucuugaugugugucugucuccacagguuggggacacccuaggagacagcagcagcucuguucuggaguucaugucgaugaaguccuaucccgacguuucuguggauaucuccaugcucagcucucugggugaguuguaacaggcacuuucccacagcaccuggugaaggugugauagaggaagaaaacacacggccuccaccuccucucccuuccugacuagacagggaugccaggaaaaucuuuuguuacgguauuuggucuuugucccagguuuuuggaccauagcuccuaaaauccuuggaaucuccugaguguugugucuuuuuuaagcuaaugagaagugguugcagccccuggguaaccucaggauggggucuggccgauccccaguggcuguggauuucaucaguguugccuaccgccuccaugaaaucccaaaaggugggguucccuagggagccucauugcuggacgccuggaggcucugggaagaaggcagccccuucccacggguccccucugcaucgcucccaccuggggcccauccguacccugggugacaccccgcagaauaaauggguaaaugucagccuaguguguggacagaagagucaaacucugcaggguauuuagagagguuucuucugagugaaauacgaagaccguggcugugacacagucccaggaggucccaagaacauuugccgaggaggacuggucugcagcuuguuuugauauguuuuagggagacagaggacaucagucaguacaugucaguuguaacagugguucguguuggaaaggcgggacaacuugaagcgaggaaugucgggucguugguggauucagagauuuccugauuggcauuugguugaaaggguuaagcucugaagagcugaagucagaaagaaaugugcaugguuaacauaagcaguuguagaagccaagguucuugucacauagaugaauucagccuucagguagcaggcuucaaaaagaguagaguagauggcaaacaucacucaugaggcccucaaagguaccagauuguuaguuaaaucucuguugggucaggaagagacuuggaaggggcaggagauucucuacagaauguagauuuuucccacaagauacagcuuugcagggcuauuucaaaauaugucaaagggauauauuuugagauaaaauacucaguuucuuucagggccugccaucuaucacgugaugcuguacuaaagucggaucggaauuuggugucuuauuaccacggagucugcuuugucaaccuucagauuucuguuuuaaaguuaaugcuggucagcugugccugaauuccaaaagaggggauaaugaggcaaguccagucccgcuucacaucauggccugaccucauuuuccagguugacuuuggagugcccuuggccaagagugggaauccguucaguccauggggcuuagaauuuuauuuuucauuuacagauguuucccugacuucugugagucacucuaggaaauucauagagcucaagucuggucuucugggaaccccauuugauagcugguuagucggaagcacagaccacagccuggggcuuucaguuggcaucagccgguggggccauccuggagacugugcccucaccugggaggcugccggugcagcgcccccgagcuguucugaccuccagcagcauuuguggugccuggauccaugggucccacugcuuugcguggugacguuccaccugucucugcuggcucuguucaggcacuuauggccgugauuuauuauaggggaagggugccaacagcagcagagggacaagagugacauccaaggaaacccagcgugaggcccagauccacucccagcagaggcacaugggacacgcuuaauucccaggagugagcugugacaacacacgugaaaugcccaccagggaagcccgucagaggcuuggugcucggggucacagggcacccccuugccaggcagguaccaaaguccagaccccggagggaaggugaacuuuagcauaaaccacucugcuccuguuguuggagcugugaacaaucccuagcacugggggggaccccagaugccagccguggcuggccuugccuuccaggggacccuggccccaggccgcugugacagcacuuuucugcacagcagcuguuuuucucagcacuucuaagauuuuguccuuauuacuacuucucagcagcuuggugcugaugggcuuuggugcugaugugcugugguguguuagucuguccucacacuguuauaaagaaccaccugagacuggucauuggugaaggaaagagguuuaauugacucacaguuccucaggcuguuugggaggcauggcugggaggcaucaggaaacuuccaaucauggcggaagaugaaggagaaacaugcaugucuucacauggcggagcaggagagaacgcaaagggggaagugcuuugaaacaaccagaucucaugagaagucacucacuaucaugagaacagagaacagcaagggggaaauccauccccaugauccaaucaccuuccaccaggacccuccccuaacauugggaauuacaauucaacaugagauuugggcaggaauacagagccaaacuguaucauucugccccugacuccucucgaaucuuuuguccuuuucacauuucaaaacacaaucaugccuuccuaacaguccccuaaagucuuaacucauuccagcauuaacucagaaguccacaguccaaagucuuaucugagacaaggcaaguuacuucugccugugagccuguaaaauccaaaacaaguuaguuaauuccaagauacaaaucggguacagacauuggguaaauagaccuaucccaagagggagaaaucagccaaaacaaaggggcagcaggcuacaaaucugaaacccagcagggcagucauuacaucuugaggccccgaaagaaucuucuuugauuccuugucucacauccaggcuacacugaugcaagggaugggcucccacggccuugggcagccccgcccuuguggcucugcaggguacagccucuguggcugcuuucccuggcugguguugagugccugcagcuuuuccagauggcauggugcaagcugucggaucuaccauucugaggucuggaggacgguggcccuuuucucacagcuccacuaggcagugccccaguggguacucuguguggggugagggcuccaaccucacauuuccccucugcacugcccuagcagagguucuccaugaagggccugccccugcagcagacuucugccuggacacccuggcuuuuccauacauccucugaaaucuagguggaggcugccaaaccucagcucuugccuucugccuacccacauacccaacaccauguggaagcuuccagggcuuggggcuugcacccucugaagcaucgacccuuuuagcccuguaccuuggccccuuuuagccauggcugggacacagagcaccauggcacaugucccagugcuucacagaguaguggggcccuuuucccuccuagacccccaggccugugauggcagugucugggcaaaggucuuugaaaugucccugagguauuaacauuuggcuccucuuuacuuacgcaaaugucugcagccuucuugaauuccuccccagaaaauggguuuuucuuuucuaccacauggcagggguacaaauuuuccaaacuuuuacucucugcuucccuuuuaaauauaaguuccaguuucaggucauuuuucuguuugugcaagugagcauaggcuuuuagaagcagccaagucaccucuugaaugcuuuagugcuuagaaauuucuuccaccaggugcccuaaaucaucucucucaaguucaaaguuccacagauuucuagagcagggucacagugcugucagucucuccuaaagaauagcaagagugaccuuugcccccauucccaaugggguccucgucuccaucugagaccaccucagccuggauuucacuguccauaucacuaucagcauuugaaucauagccaugcaggaagucucuagguaguuccaaacuuucccucaucuuccugucuuuaaguucucccagcuguucuagccucugcucauuacccaguucuacagggcaugucuguagucacuguuacuacacuuugucuacugauucccugauaucagcuuugagucucuccuaguuuggggcuguguuuuccugcuccuucguguguguuggaaucauuuacuggauaccagguggaguuuguaguugaugccguugggugauaggucugcuuacacaccuuugaggccuggcggccuuuguucugaguuugagaaguggcuuagacucugugggaccuuccccaggcauugucaggguaagcccagagucaccccggggagggugaagcugguccccuggcugguggggcucaggugaccacagaccugugugcagguucuuggcaugucuggugcacaguucaggagugggcugggagcucauccuuuccaccucucagcuggacgugcuggguccccgauggcuguggccuggaaccugcuccacagugaacugggcggguaccagggucugccggccucuugcacccuccauccagcugucuggccuuuguguguugaggacaggagcccacaccaggcccauccuggguuguggccacaucccuccacggugucugugcgugccaugacguggucugugcggugcuaggucuugucugaugcuuugcuugagcaaaggacgcugggugucugccuucccuucacucacugcuaaggguaaugucuguccuccaggccuguccaccugucugcugugagcucguccacucaguuuccagagcaauuauuguccugagcagagaggccugucuggaugggcagugugcuccugcccuuaggguagacgggccggcugagcucagccgacguggggucauguccuguuuacacagggaaggugaagaaggagcuggacccugacgacagccauuugaacuuggaugagacgacgaagcuccugcaggaccugcacgaagcacaggcggagcgcggcggcucucggccgucguccaaccucagcucccuguccaacgccuccgagagggaccagcaccaccugggugagaugcccccacccacgccgcauccccagagaccccagcacagucagugugacgucuagacgagguagugggcagcauuguaguugugggaaggcuggaggcugcaugggcagcggugcuguuguggaggucgguuuccacagauguccuugggucgcggccucggugcagagccggagcggagcugggaugcuggccuggccgcacgcuggguuacaggcuuucugccagauaccguccccaguucuguccaccccugugcccucuguggacccugguuccaguguuucugcuggggagagagcauggcuuccuuggccauguguccuggagugguuuuggugggugggguuuuguucccacuuguaaacacuggaucacucugucggcagagugaaucuuggcaguucuucagcugcagagguuuagcugcaaccaucugcaaaaaggccgguauuuucgauuccauugaccuugugaucaggguguuaacagugcauggagcaggcuuuggagggccguaggucaaagucugaggcccccgauaucccaguaugacuuugggaacugcccugaggucugggcugugucugagggacuccuggccaaggagcguucucuccuucagaagcagcauccgugcugugugcugggucagggcgaccccuggcuccagggucucuacacacagcucuccuuggcagggagugagaggugccccuguguccugggagucccugagcccuggcgguaggucaggaagcagaccuugggcuccaggagccccacgugugcugcgggucuguccuguguguugaaguccuguguucugaaaauugcaggaagcccuucucgccugagugucggggagcagccagacgucacccacgaccccuaugaguuucuucagucuccagagccugcggccucugccaagaccuaacucuagaccaccuucagcucuuuuauuuuauuuuuuuaguuuuauuuugcacguguagaguuuuugucaucagacaaggacuuugauccuguccccuuuggcaugcgggaagcagccgcggggagguaaugaauugucugugguaucaugucagcagagucuccaagccccacgaacccugaggaguggagucauacgcgaaggccauauggccaucgugucagcagagagagucucuguacacagccccgugaacccugaggaguggagucauacacgaagggcguguggccaucgugucagcagagagagucucuguacacagccccgugaacccugaggaguggagucauacgcgaaggguguguggccaggcugcagagcugcgugccguuuguguccgagcaucacguguggcuccagcccuuguuucugccaguguagacaccucugucugccccacuguccuggggucgcucuugggaggcacaggcaugggugugucuggccucauucuguaucaguccaguguguuccugucauaguuugugucucccaggcaggccaugguaggggccucgcaggggccauuggggagcacagggccaggcuggggugaggagagcuccccuguuuucuguuuaauugaugagccugggaaaggaguguguucugccugcccguuacaguggagcguuccguguccauaaaacguuuucuaacuggguguuua

SEQ ID NO: 192439 - RNA, 3843 nt, Homo sapiens
cuacucuauuuguuugagugcucuggagaaguuuucuagagcaguuuugaaagcuugcagcaagaaagcaccaagcucauugcuuguuucuugaaugucugggucaaaacuuccaaagagagguguggagacuuggauguccucucggucagcccgcagcagcacggcacgcagcuccucggcgaucucgucguauuucugcugguugaacuuggacauggccagcucguccuguggguaggcggcacccucgggguagcaguccuugggcaccgggaacucaaugcagcgcagcucggggagcucacagagugcggugaagaggcgccggagggcgcgggccgacagcggguucccgaggaacuugagcuggcgcagccgguggcaggggcucaggcccaggaucagcaugccaacguggcugucuacgaugccacacuccuccagugucaggauccucagcguccgggaagccuggcugagcagccugaagaaggucgagggguacaggcugaccagguuguguccacugagguccagcaccuccaggugggcagcgugggcacagucugccaagaaggccauguccgugugguucagggcacaguuggccagguccaguacucgcagcggggucuguagggggcugcaggacacgggggaaagagcacaggugagaggagggucccaggaaggagccgagggcucaggcgaaugggaacaacccauuuguccaucauggggucaacacacagucacguccaaccaccgccuaauuucauacagccuaugagcuaggagugguuguuauauuuauauaauaguuugugaaacgugaaaaguuacaugauauucaaacucgguguccauaaauaacauuuuaccagagcacaaccacgugcauucgcuuaguguuggccaugacugccggccgccacguggugaagucagcuauacccagaggucuggcuuuuguccucagcaccuaaaugguaaguuuguuuugucaacagcugcuuuuguguugucugagaaaagugaugcaugugaccacgagaacguccacucagaaaguggacgggguggggcagugagaccacaggacagaaugucagcucagaaagcagacggcggggggcagugagaccacaggacagaaugucugcucagaaagcagacggcggggggcagugagaccacaggacagugccgcuccacucugacaaagaugaaucccgcaugguuucagagcugggaagggccauggaggcuuccaguacagccuuugacucaccugggaacccuaaagaccccccaacuugccccacaucccauauucugacuugguugguguagggcagccuagcucuaauacaggggcaguuggagugagaccuacucugguucugagcuaagggagaucuccagagcagaacugcaucgggacauggccucacuguccucgcugagccgggggacacagcuggggucugccccaucccaacccucuccuuaggaggcugccucacucuucacccaccugcaccugcacccaccugcaugucccgcccaggacaugucccuccccacccaggacugggaccacugccaggugccccugucccaccugagaaaccacgccaggcaugcccccugcccaaggucccaccgcagggcaccucuaucccucaggacccaccgcagggcacccccauccuucaggacccaccgccaggcaucccccaccaggaucuacugccuggugccaccccaggacccacagccagccaccccccaccccaggacucaccaccaggugcccccacuucaggacccaccaccaggcaccccuaccaccgccaggcacuucuccccaaaacccacugccaaacgccccaccaggacccacugccaugugcccccagcccccagaacccaccgccaggcaccccccagcaccugaggacccaccucuaggugcuuccccaguaccuaccaggcaccccuucccccuagacccacugccaggucccacccccaggacccaaaacugggugccccccggacccaccgcuagguugccccaccaggacccaucacccggugaccccaauacccaccgccagcugccccuccuucaggacccaccaccaggcucccucccagcacccauugccaggcaccccguuccccaggacccaucacugggcaccccccuuggacccaccgcuaggcacucccccuccaggauccacugcugggcaccccccuuggacccaccgccgggcaucccccucaccacugccugaggcugccuuggccuggccccuuccuagcugcugcccucucugccuccuucacgcagaucugcugagaggauccugcauaagccuccugucccaccauggggagguccaugcagcauggagcccaggccucccucgagggagacugggaggaucccgcccugucaggccuucggaugagauggcacccuuggccaacagcagcccugagccaaaggcaccgacaggcucagauuucugagcugaaaucguguuugcuguuugaagcccccaaguguuggggugagucguucaucaacaauagacaacuccucacaccacguaggcacuucuguuucgucuguuugguaauuuccguauucucuuuuuuuaacuggcauucucuccacaucccuaagucacacauggcagcccgcuucuuuccugguggcucugacuuucggugcucuugccccuuggcggggccgcuguccuguggcuguggccacacccggagugagaggcuggaggccguguagccucauggccuuggacaugagcaggccccuggacgaucucuccuugccucugcagccaccagcccgcccucaguccccuccccaagacucacccaagcagcgucgggaucuucccggucagcguggagaaggccacacugagcucagugagcugcgccaucuugcugagcucccgggcgauggaggcgaggaggggguccucgccgucgggaguggaggcguagguggggggugcaucaaaggccuuggugggcagggugagcgaggccagccgggggaagcccaccugggccagaagcugcugcacguggcccgcaugcagccgcacguugugcaccaccuccagcuugcgcagggcacccgggccagccagacgcagcacgugcaggagcuggcuggggcucaggcuguccgcccggaacgaggggcagugcacccgcagaggggccgggcccgcuggccucagagccugcaccaccgccucgaaguugcccucagugacgaagaggucggcgaggaccucgacggggcgcccggcugcgaggggcucugccugcagcucacagcagguccuggccagcagcugggugcggccccaccugcccagcgcccucccgcacgggcaccgcugcaccugcacaucucggaugcccgugaggucagccacccgcagccgccggcggcuccgguccugcagcacgugguccgcgaggccgcgcaccagcgccuccaggcaggcccugcagguucugucgcgcagguccuggggguggucggcaccaggacccagcagcgcucccagccggaacuccuccaggggccagcgccccagcaccgcgcgcgucaccuccgccugcuccagcagguagcuggcuuugaacaggaguggguagagguugugggccacgcuguccaggcucugccgggccaccugggggugggacaccagagcuucugcagaaaugaagcggagugaccucauuguguccauggcccgagacaggaccgcuccccacgac

SEQ ID NO: 192440 - RNA, 3843 nt, Homo sapiens
gucguggggagcgguccugucucgggccauggacacaaugaggucacuccgcuucauuucugcagaagcucuggugucccacccccagguggcccggcagagccuggacagcguggcccacaaccucuacccacuccuguucaaagccagcuaccugcuggagcaggcggaggugacgcgcgcggugcuggggcgcuggccccuggaggaguuccggcugggagcgcugcuggguccuggugccgaccacccccaggaccugcgcgacagaaccugcagggccugccuggaggcgcuggugcgcggccucgcggaccacgugcugcaggaccggagccgccggcggcugcggguggcugaccucacgggcauccgagaugugcaggugcagcggugcccgugcgggagggcgcugggcagguggggccgcacccagcugcuggccaggaccugcugugagcugcaggcagagccccucgcagccgggcgccccgucgagguccucgccgaccucuucgucacugagggcaacuucgaggcgguggugcaggcucugaggccagcgggcccggccccucugcgggugcacugccccucguuccgggcggacagccugagccccagccagcuccugcacgugcugcgucuggcuggcccgggugcccugcgcaagcuggagguggugcacaacgugcggcugcaugcgggccacgugcagcagcuucuggcccaggugggcuucccccggcuggccucgcucacccugcccaccaaggccuuugaugcaccccccaccuacgccuccacucccgacggcgaggacccccuccucgccuccaucgcccgggagcucagcaagauggcgcagcucacugagcucaguguggccuucuccacgcugaccgggaagaucccgacgcugcuugggugagucuuggggaggggacugagggcgggcugguggcugcagaggcaaggagagaucguccaggggccugcucauguccaaggccaugaggcuacacggccuccagccucucacuccggguguggccacagccacaggacagcggccccgccaaggggcaagagcaccgaaagucagagccaccaggaaagaagcgggcugccaugugugacuuagggauguggagagaaugccaguuaaaaaaagagaauacggaaauuaccaaacagacgaaacagaagugccuacguggugugaggaguugucuauuguugaugaacgacucaccccaacacuugggggcuucaaacagcaaacacgauuucagcucagaaaucugagccugucggugccuuuggcucagggcugcuguuggccaagggugccaucucauccgaaggccugacagggcgggauccucccagucucccucgagggaggccugggcuccaugcugcauggaccuccccauggugggacaggaggcuuaugcaggauccucucagcagaucugcgugaaggaggcagagagggcagcagcuaggaaggggccaggccaaggcagccucaggcaguggugagggggaugcccggcgguggguccaaggggggugcccagcaguggauccuggagggggagugccuagcgguggguccaaggggggugcccagugauggguccuggggaacggggugccuggcaaugggugcugggagggagccuggugguggguccugaaggaggggcagcuggcgguggguauuggggucaccgggugauggguccugguggggcaaccuagcgguggguccggggggcacccaguuuuggguccugggggugggaccuggcagugggucuagggggaaggggugccugguagguacuggggaagcaccuagagguggguccucaggugcuggggggugccuggcgguggguucugggggcugggggcacauggcaguggguccugguggggcguuuggcaguggguuuuggggagaagugccuggcggugguaggggugccuggugguggguccugaagugggggcaccugguggugaguccuggggugggggguggcuggcuguggguccugggguggcaccaggcaguagauccuggugggggaugccuggcgguggguccugaaggaugggggugcccugcgguggguccugagggauagaggugcccugcggugggaccuugggcagggggcaugccuggcgugguuucucaggugggacaggggcaccuggcaguggucccaguccuggguggggagggacauguccugggcgggacaugcaggugggugcaggugcaggugggugaagagugaggcagccuccuaaggagaggguugggauggggcagaccccagcugugucccccggcucagcgaggacagugaggccaugucccgaugcaguucugcucuggagaucucccuuagcucagaaccagaguaggucucacuccaacugccccuguauuagagcuaggcugcccuacaccaaccaagucagaauaugggauguggggcaaguuggggggucuuuaggguucccaggugagucaaaggcuguacuggaagccuccauggcccuucccagcucugaaaccaugcgggauucaucuuugucagaguggagcggcacuguccuguggucucacugccccccgccgucugcuuucugagcagacauucuguccuguggucucacugccccccgccgucugcuuucugagcugacauucuguccuguggucucacugccccaccccguccacuuucugaguggacguucucguggucacaugcaucacuuuucucagacaacacaaaagcagcuguugacaaaacaaacuuaccauuuaggugcugaggacaaaagccagaccucuggguauagcugacuucaccacguggcggccggcagucauggccaacacuaagcgaaugcacgugguugugcucugguaaaauguuauuuauggacaccgaguuugaauaucauguaacuuuucacguuucacaaacuauuauauaaauauaacaaccacuccuagcucauaggcuguaugaaauuaggcggugguuggacgugacuguguguugaccccaugauggacaaauggguuguucccauucgccugagcccucggcuccuuccugggacccuccucucaccugugcucuuucccccguguccugcagcccccuacagaccccgcugcgaguacuggaccuggccaacugugcccugaaccacacggacauggccuucuuggcagacugugcccacgcugcccaccuggaggugcuggaccucaguggacacaaccuggucagccuguaccccucgaccuucuucaggcugcucagccaggcuucccggacgcugaggauccugacacuggaggaguguggcaucguagacagccacguuggcaugcugauccugggccugagccccugccaccggcugcgccagcucaaguuccucgggaacccgcugucggcccgcgcccuccggcgccucuucaccgcacucugugagcuccccgagcugcgcugcauugaguucccggugcccaaggacugcuaccccgagggugccgccuacccacaggacgagcuggccauguccaaguucaaccagcagaaauacgacgagaucgccgaggagcugcgugccgugcugcugcgggcugaccgagaggacauccaagucuccacaccucucuuuggaaguuuugacccagacauucaagaaacaagcaaugagcuuggugcuuucuugcugcaagcuuucaaaacugcucuagaaaacuucuccagagcacucaaacaaauagaguag

SEQ ID NO: 192441 - RNA, 467754 nt, Homo sapiens
agugacgcuccggagccgucgccagggugguaauaccuggugcagagcuugagucuggccagcgggucaggcucuugcuagaucagcaccggagguggaagacugguaagugauuuuacuggguuuucuccugcgccugauauuaauggcuggccggggcucugugcagcauuauggccagcccgagaagugagugggcgaggguggaaccagaaggaguccccaucaaaccccguggcgcuugacacccagugcagcuggagaaggcccugggaucccggcuuaccgucuuauccacucgcaaaaucugucuccgacuuggaacucgaccucgggucaccaagugucccugggcgaggccgaagacaccguguaccgugacucggcguugugccgaguuucucuaccaaugaucaacgaguuuccuaucucccauuggcagcguuuggccacucuugauuccugaguacuguuuccguaguucuggggugccgugccuggaaggcaggagguuggcugaagaagacaucuuuuacaaacauuuaggaagugagauggggagguuccuuccugauuuagaauuaauugaagguuccucccgccauuugaauuggaugagaagaacggucuuuguuuucauggcugagacauaagagaacaagcuuguaauuucaugcuugggcauuagaugcauuuuuggaaagcagugaucaguaaguaugugugcuuucagaaaggaaugcuugcguucugcuccaggcuuugucgauaaugaaggauucaggagaauuuuggauggaggucugagguagccagaauaguuguaaagagaaauugcuuccgacaaagggauaaugugaggaaaggugcucauuuaagauuugaaagaugugauguagugaaccuuggcgacuucucuuaaguaaugcaauuucuuagguaacuaguuuucacuugccaccuuauauuuagauaauuaccuccccaccaacccccguaaaaggcagcugacuguuauuuuuucaaaacagucaguucccgaaagaguuguagguacuauugcauuuuuuuuauggguaugcuccucauacccauaaaaacauuuucuuuaucggagcauaccgauaaagaaaaaugcaauauguucaauucaaggccccuguuaacaccaggccagugucuucuuaaccuuuugagaguaaugcaacaaaccauauuuaggacagcacauugauuuucuggccuuguugguuaauaauucaacaaacuuauaaucgccccauuaaucccaaucuugacauuuuguugaaucuuguauuuuuucuuuauuucuccaguugaaaguauuauaaauuacuucagggauauuauguauuauaucuguacagcaacuaguuuuuagaggcagugauuucucucuuugaauugcucuugaauguagccaaucauuaauacuuaccccaaguagauacugucugccaggcacuuuacauuuauuauuuuauuuaauguuuaauaaaaaaagaaaaucacaaaaauuguauuauuucuauuuugcaaaacauuuuauacugagacccaaagagguugugauuuuccauaaauuauacaauuaaauggcacaauuaaaauuugaauccagucuaccugacucuaaauuuuggcucuuuuuacugugcucuauaccuuuauaaguaaacauaacaguaucauuauuuucacuccagguaaaaauggauagauaguaugucacauuuagaaaucaaguggauagcaaaacuugaggauaaaagggacuuaagggauguguucaucaccauaagguaauuuugacaucuaaauaaugcaguuucuuuagugccuuuauccuuggccaguuuuauuauccuaauucaaacaaaugccuauacuguacauuagcauaacacuuggggcaaaugcagaagaucuggagaccaucagcaagcauauuggugacugaguccagaguaucagcuaacuaucucuuuagacagcuuuucacacacacauuuguauacauguauauuugugugugcauguguguguguguguguagggagaaagaaugaguaaaugagcacaaauucauaaaauucaacuuuguaaugauuuauaaggaauuauuagcaaaacugugcuguuccacucacguaacccucaaacagauggggauuaucacauaguuucaggaauaugcuuuauuaaaccugcccaucccaauacccaauucuauauagagaaacagaaauagccuaauuuucagagaauuuacaaaaauuuaguugaaaugaccaauacuagaaaugacauagaaguuaauucuaaagaauauccuguuuuacaacuguauagguauagcuagccugaaauacuaauguguauuugauuacauugcauugacuuguaggcagaucccguaggcagaucucagggauauuuugcuaucaaauuucagugcuuaugaaguuugggauuaugucuguuuuguucgucaucucaaacccagcaucuagcacugugccuggcguguaauagaagcucaauaaauaagucaggaaccaugacucaugacuguaaccccaauacuuugggaggcuaaggcaagaggauuugaauccagauccucuaaauuuuggcucuuuuuacuauguucuauacuuccuuuaauaaauaaacauaggucacagugaacuaugaucauacuacugcacucuagccugcacaacagaguaagacccugucucuaaaaaauaaaaaauaagcauuuauugaaugaaugauuccuuuuuaaaauguuauuuauccaccgagaaguauuuguacauuuuuuaaaggauuuaccacauaaauaaauauuuauuuuuacucaccuugccccugaaauacaguguccacuccacacucauucauaaaaggcaaugugcuguccugcaaagaagacuggacugugagacaggagaugagagaauaucuaauauuuuucuguguuuauucucugcuauucaguguuaaauuacuccuuacagcacaguggguaaguauuauuauccuccuuuuacagaugcuaaaacugaggcaaagauaagcuuuguaaauugucguagguuacgcauagucauuaaacacagcuaugauuugaaugaagggcucugaucccaaaagcgauaaucuuaaccacuuugcuagccuccaguugaauuuuuaauccugguucagcugcuaaaugugugcaaaagcucuggguaucauguuucucaucuauaacauauaggaguuugauggauuauauuaucuguaaggucccuccuaccucaaaaauccucugacuuuaguugacuccuaaguauuaucugaauauagcaguucuggagugccagaaaacccucaucaauuuugauguguuuuauguaagcuuuuauauguguucacgucuuccacauugguggacacacaaucauguuuuugcaauaggaagaauagaguuaaaaaaaucacagccaugcuuuuuuuuuuuuuuuuaccagcuaugacacuaauaagucacugaaccuuugugagcuuauguuuucauauguaaaauggauccauaggauugcugugagcguuaaguggguugacuuauaaagccucaaacguguugucugauacacaauugcugauaaauaaauauugauucuuuuucuugcucagucuugcaaggauaaaagauuaguggauaugaaaaaugcuuuauaaauuagacaaaggugaagaauauuuucacuuacagucuacuaggagagagaaaguuauauaaacaaauaauuauauguagggcaauuuacauacaucauugaacacaaaacaugggaaugcaaagaaaagagauuuuuuuuuuuccaggagggcagaugaggaaagaccucauaaaaaagguaauauugaguuugugccauauaggauggaaaggauuuuggcaggggaacaagagggacaaguguucuacuggaagaugcaaaggugucagaaaacagaaauaguaccuaggucacuuuggcuauguaagauggaugaaggcugguaauaaagcugagguaaaaagcugaguuuaggacaagcuguagauaacugugggcaaguuagagauguuaggcuuuuaacgauaagcaauaaucuguguguauaacuaggaugggguggaggauggaguuggcauuuguuuucuuuguuauggaaaaacgcccauuuguuacagaaacauuagaguguacaaauaugccaaaaaggaaagagaaaggaagaguggcccaugaccccaccacucagaaauaacuuaugauuuuucucuguauuacagauuugcauauaugugcuuuuaaaauaaaaaugaaauaauacugucuauauugucuugugaccugcuuuuuucaaugugcuauaccaugaauuuuuccaugucaauaaauuugcuucuauaaaauaauacuuagggccuguaugcuauucaauuuuaugaauauguuauaacuuuuaaacugacuucuuucuguuaaguaauaguacaauaaagguuuuuauaguaaaauauuuagacauauucguaucuauuuucuuauuacaauuuguagaaggagaaauggucacccacaggauaugaacacauauaauacuuacauguauugccauauuaaucaaauuuuuaauugaaacuuggugcaaaauucauaagguaugaaaggguauauaaugaggcguuagccucccucucaccucguuguccuccugacucacagcuagcccuuauagcaccuuguaugauuagaaaagggcacccccuucuggaggauccauaacucuuggauauacacuguguaacugaugcuacuuuuguaaggauuggaaaaaggcaucuuuuucucuauggcaacagcccugcagggacacauggcugggccaacaaaguauggguuggauucagccccuacugaccucccuagauugaguacuuuuaugacagguacugcaccuggccuuuuugacuauuuacuuucuaaaagccaacacuaaagccaaaugcagacuuuguuaaaauacagaagacaagauuggccggcgcagugacucaugccuguaaucccagcacuuugggaggccaaugcgggcggaucucuugagacaaggaguccgagaccagccugaccuacaugguaaaaccccaucucuaccaaaaaaauacaaaaauuagcuggguguggucgugggcacauguaaucccagcuacuccuggagucuaaggcaagagaaucacuugaaccccgggugguggauguugcagugaaccgagaucaugucaccgcacuccaaccugggugacagagugaaggauucucucucaaaaaaaauacagaggacaaggucaaacuuuagugcaucccuugaaauacauacaucccauauaaaaaguuuuaacaacuauaaaaguucaaaacgagacaaugucauuuugacuaauuaggcaaugcaguauaauguaaacaacugaauucagagaggaccugggguugagcuuaaacucaugaacauauaaugauagccuugaagaaguuacuuaaauucccugagccacaauuucuucaucuguaaaguaauacuaucaacuuuacuaggauuaaauguaauacuguguguagguacacaagcaucagaaaaaaauuauuaaggucucuaguuuuguuuuguuuuuaauaaacucacuguuuuaaauuagggucuguggcucuaacuaugaagucaaacagacuuggauuugaaucccaacucugucacaguugugugacagucacaguugugugacagugugaaaguuacuuuuccacuguuucauuauuuguaaaaugggaaugaugaugucuucauaggccuuuugugaagauuaaauaaaauaaugcauguauagaguuuaauauggugccugguguaguaaggcacuuuauuuguucaaauucuccaaaaagcagaugccaagaggagguaagauguacaagauguuuauuggggagacugcuugugaagaaugaaggagagugagaguaggaaagaaaugccuucaggccucaaugcacgucugacagccuaaaaagaagagaaggaaggaagaaagaagaguugaguaagaauaucaaagugcuacacucuucuaagaaagcuucaauuaggccagugcagaguccaaaagccaaagucauguauuagaggaaucccauguugccacgguauucaauguuagguauuaguaaaaaugaucaacaguugucaucugcuaaaacuuacaaauacauuugaauuucaaaucuugaauuuuacucccugugccacccccuccugcccucaagaaaaguauaaucccuacugccagacauugauacuaacauuugggucauauguucuuacacuaucuucuuauauuuuauaauacgguuuuguuagccagaacaguuaggaaucaaaacaucuguucccaguaacaguuuagaaaugcaaacauuagcuaaacaacugauuuuuggcaucaugugguuaaacacacuauugucuaaauuucuaaauucagguagccuauaaauauaguguaaaucuuuuuuuguuuguuuguuuguuucugagacagagucucacucugucacccagccuggaauacagugguacaucacagcucacugcaaccuugaauuccugggcucaagggauccucccaccucagccucccaaguagcuggggcuacagguaugcaccacuauguaaaaaaauuuuuuaauuuuuuugugcagacagggucucacuguguugcccacccuggucucaaacuccuguacugaagcaauccuccugccuuggccucccaaagugcugggauuacaggcaugaggcaccaugcccagccucaugccuguaaucccagcacuuugggauccaugguuagaauauuagccuaaaacuugaaugucuauuugcaucuuuaccaaagauaccucuguagccacaaagguaaaaauauaguuucauaggauccuuccccccagcccccaccaccuuuuugucauuuuuaauaaguaaacguagagauccauaaguuuagugcuuuucaaauggcagguuauaagccaucaauuugguuagucauagccuguauuuuuguuucagauacauggugguuucaggauuggggauauaaaauguauuuguuauugggaaacagcugaauuugaaaacaacugauuuagauuaacuaucauacacgaggaaaugaagauuaaagaggcgauuuaacauaauggauaacucaggaaacaugugacuugaaccagaggcuaggucuuaagaaucuaaauuuagggcuuuuucuuuuuaucaugcuuccuggaaaaggcuucuuuuuugugcuauuaguagggcauacaguuauuccaguugggugauaugauagugcuuuucugucacuuuuguuauuuguuugcuaagauuuacuaaaagacacuucccugacuuuagccaugguguaucagggagguuguacagcugcaguuguuucuagcaacuagcagucaugccacaccaccaguuuacuguccauuuuccuuccagggagcacagcuaauucaacacuuuaaggaguuuaaacugagcagugauaggaacucauuuugaagagcguuauacugaugaggucugaauuuuuguaauauagacgaguauuuugugcuucacugugucaugacuuuuuuuuuaaucuuuuuauuuauauauauauauauauauacuuuuuuuuuuuuuuuuuuuuuugcagauagagucucgcucugucacccaggcuggagugcaguggaaggaucucggcucacugcaaccuccgccucccagguucaagcaauucuccugucucagccucccgaguagcugggacuacaggcacacaguccaugcccagcuaauuuuuuuuguauuuuaguagagauaggguuucaccauguugcccaggcuggucuugaacucugagcucaggcaaucugccugccucagccucccaaagugcuaggauuacaggugugagccaccgugcccagcccuaugucaugacuuuucuuuuuucuuuucuuuuucuuuuucuuuuuuuuuuuuuugagacagucuugcucugucacccaggcuggaaggcuggaauccaguggcgcaaucucagcucacugcaaccuccaccucccagguucaagcaauucucauugucucagccuccugaguagcugggauuacaggcaugugccaccaugcccagcuaauuuuuguauuuuuaguagagaugggguuucaccauguuggccaggcuggucucgaacuccugaccucaagugauccacucgccuuggccucccaaagugcugguauuacagaugugagccaccaugcccagcugucaugacauuucuuuacccguccuccuugacuuuucaaacuuuagcucaucaaauauuuuucauuuuaaaaaugcaaguuuuguguauaaucacauaacaauguauuccuuuaaauuuuuucagauauauaauucuuuccuucucuagcauauauucaugcuagccaucggaaaugcucauggcaguucaguucuuccaaggugauccagucuguccucuacuguuaagagcuuucacugggaaggaauuuaggaguggggcugguuguaaauggggaccuucuaggcucuguuucuauguugcuuucuuuucuuucuuuuuugagaugaaaucuggcucucuugcccaggcuggagugcaguggcacaaucuuggcugacugcaaccuccaccuuccagguucaagcaauucuccugccucggccucccacuccugccucagccucccguaggcucaguuuauauguugcuuucuguacucugguaucuuuuagugcugccagugcuuauucuuuugauuaacuuuacuugguaauuaucuuucuagggcuuucucauuugucuaacucagcaguuaucaaacuuuuggucucaguaaucuuaaaaauuacugaagaccucuuuuauacucuuaaaaauuacugaagaccucagaaaguuucuauuuauguaauuauaucuacuuauauuuuuuguauuauaaauuaaaaugaaauauuuuugacaauauuuaaacaaaccacuacauguuaacaaaaacagcuuuaaaaaaaagcuauauuuuucaaaacaaaaauuuuaguggaagagugguauuguuuuauauuuugcaaugucucuucaaugucuggcuuaauaaaagagagcugaauuucagaucugcuccugcauucagucuuuggugauauauuguuuugguugaaguaauaagcaaaauccaaccuuacacauguauguaguuggaaaagaagagaguuauuuaaauggcuuuuucagauaauugugaauauucuucuuugaucaccaaaauuuaacaaguggaauuuuauuaaaauuuaguugcaguguagaaucugaaaucauaucaguuuauuuuugguacacuauuacuuuaaaaaucccuuggucuauuuuguacuuuuaauaaaucuuuuacaaauacauaauucuguuacauaauauaccagccuuuuggaaaauauugauucauugagguaugcugauuuuccaaaucuuaauagauuucauuauacaacguuaaaaauucccauuaguuaauaucaccaguagucucaucaggagacucuuguaguauuggaaaacuguccaucugacaguauacaaauuuuccaaaauucuaauuuuugcuuggaaagcucaaauuuuaucauuggcaacaaauacggucugauguuuucauugaaguuacagcccaauuugauuaauuuugagaaaauauguaguguauacaaagguuaaucaaaguauuaauacuaauuuuuggccaggugcaguggcucaggccuguaaucccaguacuuugggaggcagagauggguagaucacuugaagucaagaauucaagaacagccuggccaacagggugaaaccccaucucuaaaaaaaaauauauauauauauaauuauauauauauauauauuauauauauaauauauauauauacacacacacauacacacacaaaauuagccaggugugguggcacacaccuguagucccaguuacuugggaggcugaggcaugagaaucacuugaacuugggagguagagguugcagugagcggauauugcagcacugcacucccuccuaggcaacagagugagacucuaucucaauaaauaaauaaacaaauaaauaaauaaaaauaaaaguaauuuuuacuuccuaucgaagacauaagcaaaccuggcauuauucugaguguguaauggugaaaaaaauacaaugaguacugugguaggcaggauaauggcccccaugagauaccuacauccuaauacguagaaccugagacuauguuauguuacauggccaaggggaauuaagguuacaaauggaauuaagguugccaaucaguuuaccuuaauauagugagauuaucuuggauuauccaaguugucucaauguaauuacaaggguucucaaaaguggaagagggaggagaaaaagaaaucugaauaaugcagugggaaaaagacucaauccauauagcuagcuagaaaauggaggaagugggccacaagucaaggaaugagggcagccucuaaagcuggaacaugcaaaagaaacaaugauuuauccccaaaaucuccaaaaaggaaugaagcuccgcucacuacuugaucuuagcuuugugaggccuguuucagacuucugaccuagacaacuguaagauaauaauuuuguguuuuuaugccgauaaauuuguggugauuuauuauagcagcaauagaaaacuaauauaacuucuuguuuuuuguuuguuuguuuguuuguuuguuuuggagacggacacuugcugugucacccaggguagaaggcaguggcaugaucuuggcucacuacaaccuccgucucguggguucaagcuauucuccugccuccgccuccugaguagcugggauuauagguaccugccaccaggcacagauaauuuuuguauuuuuaguagaggguuggccaggcuggucuucaacuccugaccucaggugauccaccuaccucagccucccaaaauguugggauuacaggcaugagccaccgcacccagccugauuuccuaaagugucacagauuuugcacuuuuagugcaaaugucaauauagcaaaaaugacauauaauguuuuguuguuauaaaaauaguuuugaccuugcacaccaccugaaggaguaucaggauuccuucagaaguuuguagauuauacuuugggaucucguauauaacuucauacuuucuaugugccagccacuagccugggaaaugggauauaaaaguuaagaagguauagucuuguuuuaagaagauuauauagucuagugguugagaaagugauaugguuuggacauuuguccccuccuauugggagguguuuggaucaugguggcaggucccucaugaauggcuuggugcccuccauguaguaaugaauucacuugagagcugguuguuuaaaagagacugguaccuccuccuguuucuugaccccugucuugcaugugauacacagguucuugcuuugcccucugccaugacuguaagccuccugaggccucaccagaagcugagcagaugcuggcacugugcuuguacagccugcagaaccacgagcccccacuuuaauauguuuguuuguuuuucucugguaaauuucuuuaagucccuuuagaugcugaauauuagaucuuugucagauacauaguuuccaaauauuuucucccauucuguagguuaucuguuuacucuauugauaguuucuuugucaaaaaucacauaguuguagauaugcggccuuauuucugauaugggcucccuauucuguuccuuuggucugugugccuguuuuuguaccaauaccaaguuguuuuggucacuguugccuuguaguguaguuugaaguuagguaacaccguuccuccagcuuuguuguuucuguuuaggauuaccuugguuauucaggcucuuuuuuaguuccauauaaguuuuaaaauaauuuguucuaguucugugaagaaugucauuggugguuugauaggaauagcauugaaucuauaaauuacuuugggcaauguagccauuuuaaugauauugauucuuucuauccaugagcaugggauguuuuuccauuuguuuguguuuucucuaauuucuuugaggaguguuuuguaauucucauuguagagaucuuucaccuccuugguuaacuguauuuuuagguauuuuauuuuuguggcauuugugaaugggauggccuuucugauuuggcucucaguuugguuguuguugguauauaggaaugcuagugauuuuuguaugauuuuguauccugaaacuuugcugaaguuguuuaucagcugaaggagccuuugggcuaagacuaugggguuuucuagauauagaaucaugucauccgcaaacagauaguuugacuuccucuguuccuauuuggaagcccuuuauuucuuucucuucucugauugcucuggcuaggacuuuugauacuauguugaauggaaguggcgagagagggcauccucaugccaguuuucaaggggaaacugcuuccagcuuuugcccauucaguauaauguaggcuguggguuugucauagauagcucuuauuauuuugagguauguuccuucaauaccuuguuuauugagaguuuuuaacaugaagggauguugaauguuaucaaaagccuuuucugcaucuauugagauaaucaugugguuuuugucuuuacaucuguuuauuuggugaaucacauuuauugaguugaguauguugaaccaaccuugcauccugggaaugaagccuaguuuaucagguuucauaagcuuuuugaugugcugcuagauucaguuugcaaguauuuuuuugaugauuuuugcacugauguucagcuagaauauuggccugaaguuuucuuuuuuugcugugucucugucagguuuugguaucaggaugaugcuggccucauagaaugaguuaggaaggaguaccuccuuuucaauuuuuugaaauaguuuuaguagaagugauaccagcucuuguuuguacaucugguagaauacaccugugaauccaucugguucugggcuuuuuuugguugguaagcuauuuauuacugcuucaauuucagaacuucuuauuguucuguucagggauuuaauuuuuuccugguucagucaugagaggauguaugucuccaggaauguauccauuucuucuagauguucuaguucauuuacauagagguguuuauaauauucucugaugguuguuuuuauuucuguguagucagugguaaugucccucuuauuauuccugauuguguuuguuauuucugauuguguuuguaaucuucccucuuuucuucuucauuaauccagcuagccgucuaucuauuuuuuuaauuuuuuugaaauccagcuccuggauuuguugaucuuuuaaauggcuucuuuucuugucucuaucuccuucaguucagcccuuauuuugguuauuucuugucuucugcuagcuuugggauuugucugcuuuagguucucuaguucuuuuaauuguaauguuagcuuguuaacuugagaucuuucuagcuuuuugauguaggcauuuagugcuauaaauuucccucuuaacacugucuuaacugugucccagagauucuaauacauuguaucuuuguucuuaguuucaaaaaacuuuuugauuucugccuuuauuucauuauuuacucaaaagucauucaggaacauguuacucaauuuccauguaauuguaucauuuuugaguguuuuuuguuuguuuguuuguuuguuuguuuguuuuugagauggagucucauucugucgcccaggcuggagugcaguggugcaaucucagcucacugcaaccuccgcuuccuggguucaagugauuuuccugccuuugccucccaaguggccaggauuaaaggugcccaucaccaugcccagcuaauuuucauauuuuuacuagagacaggguuucgccauguuggccaggcuggucucaaacucucaauuccugaccucaggagauccacccaucuuggccucccaaagugcugggauuacaggcaugaaccaccauaagugaauuuuuuagucuugaguucuaauuugauugugcugugguuugagagacuguuaugauugcaauuuuuuuugcauucacugaggaguguuuuacuucugauuaugugaucaauuuuagaguaagugcuauguggcaaugagaagaauguaugauucuguuguguuugaauggagaguucuguagauaucuaucagguuuauuugauccagagcugaguucagguccuaaauaucuuuguuaauuuucugucuuguucaucuaucuaacauugucaaugggguauuaaagucucucauuuauuauuguguaagagucuaagucucuuugaaggucucuaaguacuugcuuuaugaaucugggugcuccuuuguugguugcauauauauucaggguauuuagcucuucuuauugaaucgaacccuuuaccauuauguaauguccuucuuugucauuuuuuaaucuuuguucguuugaagucucuuuugucagaaacuaggauugcaacaccugcuuuuuucuguuuuccauuugcuugguaaauuucucuccaucccuuuauuuugacccuaugugugucaucgcaugugagauggguuucuugcaggcagcauacaauugggucuugguucuuuauucagcuugccacucuuaugucuuuuaauuggggcauuuaucccauuuacauuuaagguugauauuguuauaugugaauuugauccugucaucuugaugcuagcugguuauuaugcacacuucuuaugugguuguuucauagugucauuggucuguguacguuaguguguuuuuguaaugucugguaguauuuuuuccuuuuuacauuuagugcuucuuucaguagcucuuguaaggcagguauggugguaacaaauuuccucagcauuugcuugucugaaaaugaucuuauuucuccuucauuuaugaagcuuaguuuggccggauacaaaauucuggguuggaauugcuuuucuuuaagaaugcuaaauauuggcccccaguaucuucuggcuugcaggguuucuucuaagagguucacuauuaguuucaugggcuucccuuuauaagugacuuuucucucaugcugccuauauuagucaauuuucaugcugcuauaaggacauacccgaggccagaugcaguggcucacaccuguaaucccagcacuuugggaagccgaggcagguagaucaugaggucaggaguucaagaccagccuggccaagauggugaaaccccaucucuacuaaaauuacaaaaauuagccugacgcaauggcaggcaccuguaaucccaacuacuugggaggcugaggugggagaaucacuugaacccggguggcagagguugcagugagcugagaucaugccacugcacuccagccugggugacaaagugagacucugucucaaaaaaaaaaaaaaaggcauacccgagauugggcaauuuacaaagggaggagguuuaauugacucacaguuccucaggaaacuuacacucaugguggaaggugaaacaaacacuucuuuuuucacaaggcagcaggagagggaagaauggaaggugaagcaaacacuuccucuuucacaaggcagcaggagagagaugagagccaagugaagagggaagcccguuauaaaaccaucagaucuugugagaacucacucacuaucaugagaacagcaugaggguaagcacucccuugauucaauuacuucccagaggguuccucucaacaacacguugggauuacgagaacuacaauucaagaugagauuuggauggggacacagccaaacuauaucacugcccuuaacaauuuuucuuccauuuccaccuugaagaaccugaugauuaugugucuuggggaagaucuucucauggaauaucuuuuuuuuuuuucuuugagacagagucuugcuaaguugcccaggcuggagugcaguggcacgaucucggcucacugcaagcuccgccucccagguucacgccauucuccugccucagccucccgaguagcugggacuacaggugcccgcuaccacaccuggcuaauuuuuuuuguauuuuuaauagagaugagguuucaccauguuagccaggauagucuugaucuccugaccucaugauccgccugccuuggccucccaaagugcugggauuauaggcgugagccaccucgcccagccuucucauggaauaucuuagcaggguucucugcauuuccugaauuugaauguuggccuaucuagcaagguuguggaaguucucauggaugauauccugaaauauguuuuccaaauugguuccauucgccucaguucuuucagguacaccagucagucauagauuugaucuuuuuacguaaccccauauuucucggaaauuuuguucauuccuuuuuauucuuuuuuucucuguucuugucuaccuguccucuuucagaaagacaguuuucaaguucugagauucuuuccuccuguuggaguauucugcuauuaauacuugugauugcauuaugaaauuguuguaugguguuuuucaguucuauccggucaguuauauccucuguccuggauauuuugucagcuccugcaauguuuuauugugauuuuuagcuuucuugcauugauuuaagacaugcuccuuuagcucagugguuuguuuuuaucuacauucugaggucuacuucuguucagccauaucagccucagccccuuuccaaaaccuugcuggaaaggugauguggucauuugaaggagagaaugcacucuggcuuuuuuugaguuuucagcauucuuguacugauucucaucuuugugggcuuuaucuaccuuuauucuuugagguugcugaccuuuggaugggguuugggguuuuuucguuguugcuguuuucuuuuuuaagagucugaccacuuucccauagcgcugcugcaguuugcugggcaucugcuccagucccuaguugccucagaucuuccaguaucuggagguaucaccagugaaggcugugaaauaguaaagauggcagccuaccgcuaccucugggagcuuugucccaagggguacagaccuguuauuggcccaaauguacaugcaggagguaauuggagaccccaguuggggucauccagccaggaggaacaggaucauggggaucugcucuacuuuaguagagcagccaugcugugcugcgguacucuuucugcccccgcaucagguugggcuuucugaagccuagaggcuggaauagcuaaguugcugaaacaccuaaguugcugaaacagcaaagauggcggccaaccccucccucuagaaacucuuucccaggaaauuuucaaaccucugugggcuagagaaugucagugggaguggcuggagucccccauuuaggaagucccauccagugaggagaaacagauuggggacccacuuaaggaagcaaucuggucacacuuuuguagaguagcuauguggugcugugguacuacuuccacucccaggugguuuggacucucuuaagcccacagacuagaauggcugaguuguccaagcagccucaaguauuccuuuauagaaauguaaacagauuaacacagagagguaagugaaucagugauggcagacagcacagagugaccagcacccuaacagaggcauaaucaaguuauggugguaauacuaaauauauauuggagaaagaaagagacauaauccuucucuuuauguguuuucaguuuacugagaugacaaaaaugauuauaaaauacauuaagguauuaaggaaauauaaggaauauauauauacacauaaggaaauauauaaggaaauauaaggaauauaauauauguaaggaaauauaaauauaaggaaauauaaggaauauauauaugaaacuauauaaggaaauauaaggaauauaauaugcuauuaaggaaauauccccacugaugggacagggaagaaauguuuauaauucaucagcuguguaugaggguuucaauuucuccacauucucccaucacuuguuauuuuugucuuuugauuauagacguucuagugaguugugaaguggcaauacuuccccaaauuaaucuacagauuuaaugcaauuccuauuuuaaaaacccagcugauaucucauguggucucaauuugcauuucucuaaugauguuaaacauuuuuucauguacuuauuggccauuuauaugucuuccucggagaaauauauauucaaauucuuggccauuuuaaaauugaguuauuuaucuuuguauuguuuaguuguacuaguuccccccuuuuuuuuggggggguggacaacacaugacaguauugaucuuaaucuagaguuucauaguaaacuugcuaaaaccuaaaucagauuacauuccucugagcuccaaaaccucugcggcauuccauugccuccugcagucuuacuggggcagagaaugcugugaagauuuuguacuagugcuuuauguauucugggauacaugauuugcauauauuuucuccuauuccauagguugucuuuucacuuuguggauaaucuuugaaacacagcaguuuugaauuuuaaugcaguccaauuuaucaauuuuuuucuuuuguugauucugcuuuugguauuacauuaagaaaccauugccuacuccagugucaagaagauuuccaccuuugauuuguucuaagaauuuuugcauuuuaguucuuaaaguuuuugaucaacuuugaguuuuuuuuuaauaucuugugaggaaagaguccaaguauaauucuuuguauguugauauuuagugucucagcaacauuuuuugagaagacuaauauuuucccuguuaacuuuucauggaacccucaucaaaaaucaguugaaauacaagaaacuccauagcaaaaaaaaaaaaaaaaaaaacccaaauaaucagauuuuaaaauaggcacaggaucugaauaggcauuucucaaaagaaguuauacaaaugcccaauaaguauaugaaaacaugcucaacaccacuagucaucagggaaaugcaaaucaaaaucacaaugagguagcuucuaaucccaguuaggauggcuauuauuaaaaagacaaaaaauaccaaaugcuaucaaagaugcacagaaaagagaacucuuacauacuguuggugggaauauaaguuaguacaaucaugauagaaaacaguauucagcuuucuaaaaagaaaaacugaaaauagaacuaccauaugauccagcugucccucuacugaguauucaucuaaaggaaaggaaaucaguauauugaugaaauaccuucacccccauguuuauugcagcacuauucacaauagccaagauaugaaaucaaccuaaacgucuaucagcaaaugaauggauaaauaaagugugguauacagucaugugccacauaacgacauuuuggucaacuaaagaccacaaauaugauaguggucccauaugauuaucauggaucugaaaaauuccuuuugcccaguaauaucauagcugucauauguaguguaaugcauuacuuguguuugugauaaugcugguguacacaaaccuaccaguuuuauaaaaauauaauuauguacaaagcauacagugcauaauaguugauaaugauaauaaaugacuguguuacugguuuauguauuuacuauauauuucauuauuauuuuagcauauucuucuucuacuuauaaaaaagacuguuaacuguaaaacaguuaacagcuucccuguaaaacagcuucaagcaaguccuucagguaauauuccagaaaaaaagcauuguuauagaauauuucagaaaaaggcauuguuauacucccuaugcuuguuauugcccaugaaaaccuuccagggagacaaaauguggagguggaagucugugauauugaucacccugacccuguguaggccuaggcuaauauguguguguguuucuuauuuuuuaacaaaauaguuucaaacauuaaaaaaagucuuaaaauauuuuuuaaaaacuuauagaauaaggcuauaaagguaaauauuuuguacauuguguuuuaugcuaacuguuauuacacaaaaguaaaaaaauaauuuuaaguuuauaaaguaaaaaaguuacaguaagcuaagguuaauuuauuauugacaaaagaaaaauacuuuuuacaaauauaguguagccuaaguguacagugguuaauaaagucuacaguaguguucaguaauguccuaggccuucacauucacucaccauucacugacucacccaaagcaacuuccaguccuauaagcuccaugaaugauaagugccauauaccaguguaccauuuuuuugucuuuuauacuauauuuuuaccauaccuuuucuauguuuagauacacaaauacuuaccauuguguuacaauugccugcaauauuuaguacagucauaugcuguaacaguuuguagcccaggagcuguaagcaauaccauuauagccuagguauauaguaggcuauaccauugauguuuguguagguacacuguaugauguucauacaaugaaaaaauugccuaaugaugcacuucucagaauguaucaccaucuuuaagugacacaugacuauauacagaaugggauauguuugucuuggauaucaggguaguacugucauuguagaaugucuuggaaagguuucuuuccuuuguuuccugaaagagcuauuaauuacuuucaaacacuuuuaugcaucauaugaaauguguaauauuguguuuuuucuuuaauucaguaaaauauauuuucuuauacugcugucacuuuuuuuggugcauugguuauuuaggagugugcucuuuaacuuccaaauauugaggguuuucccagauuucuuucugcuauugauuucuaauuuaauucaguugugcugauaaaacauauguuuuaugauuauauucuuuuaaaauuuauugagacuuguuuaugaccuagguacauggucuauuuuggauaauguucuugaugguugcccaaaaauguguauucucagccaacaucauacugaauggccaaaagcugggagcauuccccuuaaaaacuggcacaagaaaaggaugccaucucuaaccacucuuguucaacauaguauuggaagcccuggacagagcaauaaggcaagagaaagaaagaaacagcauccaaauaggaagagaggaagucuuacuaucccuguuugcagaugacaugauuuuauauguagaaaacgacauagucucagccuaaacacuccuuuagaugauaaaauaacuucagcaaaguuucaggauacaaaaucaacauauaaaaauuacuagcauuccuauauaccaacaacaaccaagcauggugccaaaucaggaacacagucccauucacaauugccacaaaaauaauaaaauaccuaggaagacaacuaaccagggaggugaaagaucucuacaaugacaauuacaaaacacugaugaaauaaaucagagaugacacaaauaaauggaaaaacauuccacgcucauggauugauagacucaauaucauuaaaauagucauacugcccaaagcaauuuacagauuuaaugcuauuccuaucaaacuaccaaugacauucuucagagacuagaaaaaaacuauuuuaaaauuccuauggaacaaaaggagcccaaauagccaaggcaauccuuagcagaaagagcaaagccagaggcaucaaguuagucaguuuuaaacuacuacagggcuacaguaaccaaaacaucauguuacacuauaaaaacagacacauagaccaauggagaaggauagagagcccagaaauaaggccacacaccuacaaccaucugaucuuugucaaaguugacaagaacaagcaauggggaaaugaccccuauucaauaaauugugcugggauaacuggcuagccauaugcagaaguuugaagauggaccccuuacuuauaugauguacaaaaaucgacuaaaauggauuaaagacuuaaauguaaaacccaaaacuauaaaaucccugggagaaaaccuagaaaauacaguucuggucauaggaaguagcaaagaugucaugacaaagaugccaaaagcaauugcaaaaauugacaaauaguaccuaauuaaacuuaagagcuucugcacagcaaaagaaaccaucaacagaguaaaaagacagccugcagagugggagaaaauauuugcaaacuauacaucuggcaauaaaguccaggcugagguguucucagauggagaugaggaacuuguugggaacuagagcaaugauaacucuuguuauacuuuagcaaagagauugguggcauuuugccccugcccuggagauuuguugaacuuugaacuugagagagaugauuuagaccaucuaguggaagaaauuucuaggcagcaaagcauucaggaugugaccuggaugcccuuaaaagcauucaguuuuauauagucacagaaagaugguuuggaauuggaacuuauuuuuaaaagggaagcagagcauaacaguuuggaaacuuuguagccugcugaugcaauagcaaagaaaaaugcauuuucugaggagaaguucaagcagcugccgaaauuugcguaaguaacgaggagccaaauguuaaucgacaagauaauggggaaaugucuccaggguaugucaaagaucuucacagcagccccucccaucacaaguggggaagccuaggaggaaaaaaugguuucgugggcuuggcccauggcuuugcugcugugugcagucuagggacuuggugcccuguaugccagcuguggcuaaaagggagcaacguacagcucaggccguugcuucagagggugcaauuccccaagccuuugcagcugacacaugguuaucagccugugggugcacaaaaguaaagaauugagcuuugagaaccucugcuuagaguucagagauguauggaaauguauggguguccagacagaggugugcugcagggguguagcccucauggagaaccucugccagggcagugcagaagggaaauguggaguggcagcccccacacagaguccccacugggggacuaccuaguggaacugugagaagagagccaccauccuucagaccccagaaugguagaucugccaacagcucgcaccuugcaucuggaaaagcaacagacacucaacgccagccucugaaagcagccaggagggggacuauacccugaaaagccacagaaguggagcugcccaaggcugugggagcccaccucuuacaucagcaugccuuggaugugagacauggagucaaagaagauuauuuuggagcuuuuuuuuuuuuuuuaucuacuauuuuuuauuugagucaggccacuuaauuaaaauaaguccaaaugugacacaugauaacacucauuuuaaauaaaaacuacaaucaugauucgacuucucuaaaugcauguucucucagguaguccauccaagcauccuuuguugacagugccauagaguuccauucaaaccaaggaaucugaauuauaugauagcccaaaaauuccaaaugucauuuuuucauagaagauuuuccuuuuaugugaaggauauuucuacaaaaugcuuuugaauccaaaaauuccaaagcaauccuuucagcuccugguggcagccuugauccaacuauuucaguauuugauucccagggcauuucugguaguugucccaauguuauauuauggcuuccauaaagaagagauuuuuuucuuucuuccaagauacacucaaaaucuacuguaugguaauaaggaguaagaacugaggcuuuuacacaauugauuccuccuaguaccucugcuaacauuuuauaaaucugcuguugugcuacauucaugccagcaauaccuuuauuauauugcugacagaagcagucgagaaaccaugggaucugaaacucagggcauuccaagcagacugaucuauuuaguuccauaagacaaaacuggacucuugcacuuagagaugaagauaaaauuucaaguugagaauccagucuagcuaagaauuugauauuaaaauuaccuuuagcagauauucaggaaaauauucaaguguggccaaagagaaaccaagaaacacuaacauaagaggauccaauauaccuaaguagaaauuaagauguugcacgcaaguuccaaaaacuucaucccuuugagguggaucauaguuaaaaauucugaauggaagaguaauagcaaggauucuaaauggauggauuuauuugggucacacugugguaaaacugcuucaauucuggauauucccacuucguccaaaugaggagaagggagcagggaaauagcagaggccagaauggacaucucaguugguaugaaacuaauuuucaaauaacuaagcaauaauucuccaaguuucacaaaaaaacucccuacuuuggaaaugcagaaaagucaaugcuugaguuaucuucaacaacucuaauuguuuauaguuauccaaauguuugugcagaacugaagcaacucuuuuaaucagacaugaauuucugcuuucuauaucuuccauuguucccaacacuaccagggcuuacucguugguuagcuccucugacaucaauaacauaguugauuuaaguuguuucuuuucuucagguccugcaaugggucccaaugcuacaaaaaacuuuacaaagcuuucuaauagugguugauaaugauaucuaaaguuucgaagaaacuguaccauucuuuuugcaacguugaccucagaagaaucuguggugucaaaaacaaguuccguuuuguucaccaguuguucuugaaaaugucgugauauuaaagaagauauguugaccaucaagacagacaaggaacuuaaguucuggaugguuuccaaguuccuauggacaauaucagcuauuuuucccauuaauggacuaaaauacaaaugcugaucugcuaagcaagaggaaaauucugacagcaguuuaauaucaaaccuuucuagccuaccccaugcuucuguaacuagugcuucaacuagcggaucgugggccucaccagcaaacuguugugugauguauaacacauucaccaggguauugccauucauuaauuugaauuuauuuguagcuaaauuaugaagaguaagaaauugagaauggucucugacauacucaacauuuuuuaauagacugaucuucugcuuuugaagcuuccaaaguauauuaaauguacaucccacuuguuuuucugaaaguaugauuuuguuucuuucaauaaaaucaaauauuugcuccucaucuauacacuuauucaucugaauaaugagugguucacaacugaugagucgaaauugaaacacaguccaggagaauggacaaauagcucuuagccgaagcauauuuguaaccaaugagucuaggcaaacagauguuuuuugauuuacaucacaaauuuucuuagguaaacaaaaccgucuguaacuaguugucaggugcaacaaacagggauaaaaggaacuguuuuuccuucguguauuuugcuuccauuacgauaacuguaaacccauuccaauguacagcuucagcaagguuuuccaucaucacacugcaacuuuucuggaggcuccugggguuaugagagaucagaagucaggguuauuccuggucccaacauggaaugcaacugucuugguugucucacccaacccucauaucccaggagucauagccuuuccucgagagacaucaccuuucccaugauagagcuugcccccagaccaggaaaaaaugcccagcgagagcagcaugcacugcagaagucaccuauuuugaagcuuuaagauuugacugcccugccagauuuuggacuugcauggggcuuguagcuccuuuguuuuggccaauuucucccauuuggaauggguguauuuacccaauaccuguacccuugcuguaucuaggaaguaacaaacuugcuuuugauuuuauacgcucauagguggaagagauuugccucaucucaggugaaacuuuggacuguguauuuuugaguuaaugcugaaaugaguuaagacuuugggaaacuguugagaggccugauugguuuugaaaugugaggacaugagauuuggcaggggccaggggcagaaugauaugucuuggcuguguccccacccaaaucucaucuugaauuauagcugccauaauuuccacaugucaugggagggacccaguaggagguaauggaaucaagggggugggucuuucccaugcuguucucaugauacuaaauaagucucaugagaucugaugguuuuauaaaugggaguuccuuugcacaagcucucuugccuaccaucauguaauauaugccuuugcuucuccaccuuccgccaugguugugaggccuccccagccguguggaacugugaguccauuaaaccuauuuuucuuuauaaauuacccagucucggguauuucuuuauagcagugugaaaaugcacuaauacagucucuaaugugaaaaaccauuuuuucuuugaaugucagucaaguaguccuucgcuaugcauucauauuagaaaaaagaaaaucuaaaacuacauagaauuuauuuggauaacacugauuuuacugguauacuuugcuuuaaaugaauagguugguaaugaucaguaugcuaaagucagcuaaagaccagaaugaggcaggcuuuuuugggggguacccaugcccaugcuuucauaguuuuguagacauuuaauucaugucuugaagcauaucauuucuugcauuuauuucccuuuacccacagucagaucuuuaauuaaagacaaagaaaauacaaaguaguggcuugcacuaaaagguaaggaagggagauucauuguuucuugagcaaaccuucaauugauuguguuuuuuagcuucacuuuuuacuccacucucugccauggauaucaggucauucuuuuaauuacaguccucuuugcauacauuuuagaguuuggcuuuuucuauucuguuucuucugugaauucucuuucaucugucuguguuuuauaaauuugugaugaugacucuucauuuuuguggguuuauauuucucuucuccauaauauaacuucuuuaccuuuuuaagguauaucuggagggacagaaggaaaauguaugcugcuugagcuuccuaaccagaaauuuuguucacauaauuuuaaacaguuuuaacguaauguguacuugcuuuuuaguccuguuuuccucuccuuuuaaacauuuucuacauugcucuccuuuuucauaauugcuguuugcaguagauuauggaaauguuuuuaaagaaacuguuuuuauuauuaugguuauuauuauuuuaguuacuacuuuuuucucuuuaugcauuccuuuaucccagcaucacacacauuugccuuuccuuagauaaccaauguuaccaacauugacaauguguggaauaguaagucuaauuguuuccuuugucaaauaauugaaagcuaugaagaagcacaguuugcuuuaaagccggcugacauugucaucaagaaagcaauuucaguuauguauugauuuuacaagaaaccuugugauuucagcuaugggguauaggugauuugcaguaucucaguaauggcuuccucacauuggcauccucaccuuaguucuuagauugaauggaaccauuuuccucaugauaaugccacuguuuccuuuugcuuuucaacuacuucucaguguggcuguuguccuugagaguucguguccauuucugauuaaauaucaacuggaauuuggcuugggauaaugaauguuaguaauauuuaaggacuuguauaccagacaccauagaaagacaggcaauaugaggacaaauaaaugguauaagaaaccauuggaggcugagugcugugucucaugccuguaaucccagcacuuuggaaggcugacgcggacagaucacuugagguugggaguucgagaccagccuggccaacauugcgaaaccccaucucuacuaaaaaugcaaaaauuagccaggugugguggcgcaugccuguagucccagcuacucuaauggggaugcugaggcaggagaaucgcuugaaccugggaagcagagguugcagugagccaagauugcgccacuccacuccagccugggugacagagugagacucugucucaaaaacaaagaaaaaaagaaaccauuggagucuaccucauauccauuuccuagaaaaucuaaccuaaccgagagaucauguuggcugaucauagauaacaaaauagccaucuauuucuauuauuucaugcauuugcuguuugaccuuuuuugcuuuuuuuuuuuuuaaagugagacaggauaaaguacagauuuuggaaauaaagaaauaaagcucauuauuugugcaugauguaaaacuacuggaaaaaauaagaguuuaucaaauauccuggaugaacacaucaaccuaccaaaauuauacacauaauacauauauacaaaaaagggaaaaguuuuugcaaggagauauaaucaaaauauggagugccuagaaauaaauacaacgagauguacaaaacucccauggggaaaguaauagagcguuauuuuguaauauuaagaccucaauaagugaaauuauauacaauacacaugauuuggaaaacucaaugcuauacauuugcccaacuuugauagagauucaaagcauucucugucaaauuccuaacucucuuuguuuuggugaggagggucaaacacuugaaaaaagauuuuaaaauuauauggaaaggcaaugucaauagccaagaauaacaauaguagacuuugcugcaggaaaagacaaauagauuaguggaagcuuauuagugaauggguaguccauggacccacaccauuaguggcuuuaccugggaccuuguuagaaaugcaaaauuucaggccccaaccccaaaucaacuuaaucagaacccauguuuaacaagauucccaggaaucuguuuuuuuuguuguuguuguuucuuuguuuuaguuauacucuaaguucuaggguacaugugcacaaugugcagguuuguugcauagguauaccugugccguguugguuugcggcacuuuuacauuagguauuucuccuaacucuaucccucccccagcccuccacccgccaacaggccccagugugugauguuccccucccuguguccguguguucucauuguucaacucccguuuaugagugacaacaugcaguguuugguuuucuguccuugugauaguuugcugagaaugaugguuucuagcuucauccaugucccugcaaaggacaugaacucauccuuuuuaugguuguauaugugccacauuuucuuuauucagucuauuauugauggacauauggguugguuccaagucugugauauugugaauagugccacaguaaacauaugugugcaugugucucuauaguaccaugauuuauaauccuuuggguauauacggaguaaugggauuacuggguaaaaugguauuucuaguucuagauccuugagggaucaccacacugacuuccacaaugguugaacuaauuuacacucccaucaauaguguaaaagcauuccuauuucuccacauccucuccagcaucuguuguuucccgacuuuuuaaugauugccauucuaauuggugugagaugguaucucauugugguuuugauuugcauuuuucugaugaccauugaugaugagcauuuuuucauaugucuguuggcugcauaaaugucuucuuuugaaaagugucuguucauauccuuugcccacuuuuugauggggacuuuuuuucuuguaaauuuguuuaaguucuuuguagauucuggauauuagcccuuugucagaugaguagauugcaaaaauuuucucccauucuguagguugccuguucacucugaugauaguuucuuuugcugugcagaagcucuuuaguuuaauuagaucccauuugucuauuuuggcuuuuguucccauugcuuuuguuguuuuagucaugaagucuuugcccaugccuaugucgggaaugguauugccgggcuuucuucuacaguuuuuaugguuuuaggucuuacauuuaagucuuuaauccaucuugaaucaauuuuuggucagauguaaggaagggauccagugucagcuuucuauauauggcuagccaguuuucccagcaccauuuauuaaauagggaauccuuuccccauugcuuguuuuugugagauuucucaaagaucagaugguuguagaugugugguguuauuucugaggccucuguucuauuccauugaucuauaucuguuuugguaccaguagcaugcuguuuugguuacuguagccuucuaguguaguuugaagucagguagcaugaugccucuagcuuuguucuuuuugcuaaggauugucuuggcuaugugggcccauuuuugguuccauaugaaauuuaaaguaguuuuucccaauucugugaagaaagucauugguagcuugauggggauagcauugaaucuauaaauuaccuuagggaguauggccauuuucacgauauugauucuuucuauccaugagcauggaauguucuuccauuuguuuguguucucucuuuuauuucguugagcagugauuuguaguucuccuugaagaaguccuucacaucccuuguaagcuggauuccuagguauuuuauucucuuaauaguaauugugaaugggauuucacucaugauuuggcucucuguuugucuguucuugguguauaggacugcuugugauuuuugcacauugauuuuguauccugagacuuugcugagguugcuuaucagcuuaaggagauuuuaggcugagacaaugggguuuucuaaguauacaaucaugucaucugcaaacagggacaauuugacuuccucuuuuccaaauugaauacccuuuauuucuuuaucuugccugaaugcccaggccagaacuuccaauacuauguugaauaggagugaugagagagggcauccuugucuugugccaguuuucaaagagaauguuuccaguuuuugcccauccaguaugauauuggcuguagguuugucauaaauagcucuuauuauuuugagauauguuccaucaaaaccuaguuuauugagaauuuuuagcaugaaagguuguugaauuuuguugaaggccuuuucugcaucuauugagauaaucaugugguuuuugucauugguucuguuucugugauggauuacauuuauugauuugcauauguugaaccagccuugcauuccagggaugaaggugacuugaucauguuggauaagcuuucugaugugcugcugaauucaguuugccaguuuuuuauugaggauuuuugcauugauguucaucagggauauuggucuaaaauucucuuuuuuuguugggucucugccaggcuuugguaucaggaugaugcugaccucauaaaaugaauuagggaggauucccucuuuuucuauugauuggaauagucucagaaggaaugauacaagcuaauccuuguaccucugguagaauuuggcugugaaucugucugguccuggaguuuuuuugguugguagccuauuaauuauugccuauuucagaaccuguuuguuauucaucuauucagagauucagcuucuuccugauuuagucuugagaagguguauguguccaggaauuuauccauuucuuccagauuuucuaguuuauuugcauagagguguuuauaguauucucugaugguaguuuauauuucugugggaucagugaugauauccccuuuaucauuuuuuauugcaucuauuugauucuucuuuccuuucuucuuuauuagucuggcuaguggucuaccuauuuuguugaucuuuuagaaaaccagcuccuggauucauugauuuuuuugaaggguuuuuuaugucucuaucuccuucaguucugcucugaucuuaguuauuucuugucuucugcuagcuguugaauuuauuugcucuugcuucucuaguucuuuuaauugugauguuagggugucaauuuuagaucuuuucugcuuucucuugugggcauuuagugcuauaaauuucccacuacacacuguuuuaaaugugucccugagauucggguauguuaugucuuuguucucauugguuucaaagagcaucuguauucugccuucaugucauuauuuacccgguaaucacucaggagcagguuguucaguuuccauguagauuugugguuuugagugaguuucuuaauccugaauucuaauuugauugcacuguggugugggagacaguuuguugugauuucuguucuuuuacauuugcugagguguguuuuacuuccaauuaugggguuaauuuuagaaaaagugcgacguggugcugagaagaauguauauucuguugauuugggguguagaguucuguagauaucuauuaagcccgguugguccagagcugaguucaaguccuggauauccuuguuaauuuuccaucucguugaucugucuaauauugacagcaggguguuaaagucucccauuauuauugaguggaagucugaaucuuuuuguaggucucuaagaacuaguuuuaugaaucugggugccccuguauugggugcauauauguuuaggauaguuagcucuucuuguugaauugaucccuuuaccauuauguaauggccuucuuuguuucuuuugaucuuuguugguuuaaagucuguuucaucagagaccaggauugcaaccccugcuuuuucuuugcuuuccauuugcuugguagaucuuccuccaucccuuuauuuugagccugugugucuuugcacgugagaugggucuccugaauacagcacaccaaugggucuugacucuuuauccaauuugccagucugagucuuuuaauuggggcauuuagcccauuuacauuuaaguuuaauauuguuaugugugaauuugauccugucguuaugaugcuagcugguuauuucacccauaaauugaugcaguuucuucauagcauugauagucuuuauaauuuggcauguuuuugcaguggcugguacuaguuguuccuuuccauguuuagugcuuccuucaggagcucuuguaagucaggccugguggugacaaaaucucucagcauuuguuugucuguaaaggauuuuauuuccccugcccuuaugaagcuuaguuuggcucaauaugaaauucuggguugaaaauuauuuucuuuaagcauguugaauuuuggcccccacucucuucuggcauguaggguuucugcagagagaucugcuguuagucucaugggcuucccuuuguggguaacaugaccuuucucucuggcuguccuuaacauuuuuuccuucauuucaaccuuagugaaucugacgauugugugucuugggguugcucuucucgaggaguaucuaugugguguucucuguauuucuugaauuugaauguuggccugucuugcuagcuuggggaauuucuccugaauaauauccugaagaguguuuucuaacuugguuccauucuccccaucacuuucagguacaccaaucaaauguagauuuggucuuuucacauaaucccauauuucuuggaggcuuuguucaguuauuuucacucuuuuuucucuaaucuugucuucucgcuuuauuucauuaauuuggucuucaaucacugauauucuuucuuccacuuaaucaaaucggcuauugaagcuuguguaugcuucacgaaguucucguacugugguuuucaagaccaucaggucauuuaagcucuucucuacacugguuauuguaguuagccauucgucuaaccuuuuuucaagguuuuuagcuuccuugcgauggguuagaacaugcuccuuuagcucggagaaguuuguuauuaccaaccuucugaagccuacuucugucaacuccucaaacucauucuccauccaguuuuguuccuuugcuggugaagaguuguguuccuuuggaggagaagaggcauucuggcuuuuggaauuuucagucuuucugcucuaguuucuccccaucuuugugguuuuaucaaccuuuggucuuugauguuggugaccuacggaugagguuuugguguggauguccuuuuuguugauguugaugguauuccuuucuguuuguuaguuuuccuucuaacaggccccucagcugcucagcugcaggucuguuggaguuugcuggagguccacuccagauccuguucgccuguguaucaccaguggaagcugcagaacaggaaacauugcugccugauccuuccucuggaagcuucgucccagaggggcaccugccuauaugaggugucugucagcccugacugggagaugucuuccagucaggcuacacaggggucagggacccacuugaggaggcagucuguccauuauuggagcucgaacaccaugcugggagaaccacuguucucuucagagcugucaggcagggacguuuaaguuugcagaagcugucugcugucuuuuguucauauaugcccugcccccagagguggaaucuagagaggcaguaggccuugcugagcuguggugggcucuacccaguucgagcuucugggccacuuuguuugcacugugagcauagaaccgucuacucaagccugaacaauggcugacacccuucccacugccaagcuccagcaucccaggucgaucucagacugcugcacuagcagcaagcaaggcuucauggguguggggcccaccaagccagacacaagagggaaucuucuggucugccaguugcaaagaccaugggaagagugcaguauuuggacaggaauguacuauugcuucagguacagacacucacggcuucccuuggcuaggaaagggaaaucccacgacccuuugcacuucccggccugcuuuggcucacccuccaugggcugcacccacuguccaaccagucccagugagaugaaccagguacuucaguuggaaaugcagaaaucacccgucuuaugcgucgaucucgcugggagcuguagaccggagcuguuccuauuuggccaucuuggaagcgccucccccagcaaucuguuuuuaacaggaucacccagaagaauggggaaaagacgguuuuaauaaauaauuuggagcaaauaguaacuaaacaagaaaaaaaguauuuggauugaauaacauugcuuguuuuauauggugcaaccacacguuacucucuuugugauaaauuucuuuaggagugaucaauuuuuagugaaaauauaaggaauguuuuaaauaugcauuuuccaaggugccccuauuaccuguguugcugcagucuauggacuaucuuauuaauaagcuuuucuuauguauguaaucuucaggauguuuuuguguauuuccaacaucucuucuuccugacucaaguccauauguuaugauuuaaugguaguacugucacuagcaaucugggcaacuaaugugaauaugcccuccaucccauuguggcagugauaaagcuuuaugcaaucauuuuucagguacauuuuacauacuuugggaaaaaaaaacguugcugaaguuacuagaaaagagacaguucuucugcugacaacucuucaggaaauaauuuucuaccuccuuaggauucgaagaccaguucauucuuagugucuucugaaauaaaauuagguaagaaauguuuuucuucauauuuugaguaauuuauacuaugccuacucaguuuccuugaaagcuucuauaauucuauuccuuuggccucuaagagaauacaguuagcuuucuccuuuaggaaguuagugugccagccagcugucggcuuuaugauuuaccugaucuccaauguuagggaaagcacaauuugauuuuuaaccaagucuucuacacaacacugcagcagggccaccggcaucucucuuuauguuccuuucuuugaaauuccccauucuaugcaaacaguauacuuuuauuuuuaaauucuugugagauaaaaccaccacuaacugacuuuacuugucuuuaguucaaaaucaaugaauugaaugaaauaauucauauuucuguuacccuuucuuauuuccagaaaauaaaauaccacugcuuguuuaacuugugacuugucuaaacaaguugaaagcauugacuauaaggcauaacacucagacucugaaagggaacugugacaaguucagucaaaagggaaaagacgaauaauuuauaaaaggcacugcagauaaugaugccagccaguuauuuuaaaaugcauccaccucaccuuuuaaugaauuagauuugucaacagcaaauguuuuaugcacuacuucuaauaaaaguggcaugcugggaaugcagugcuuugagguuggcuucuucaaagcuuuagaguaucuucaauucaaagauauuuuuuaaauaauagauauuaaaaaguauauuuaaauaauauuaagguugugacacaaacaccaaaugacaaaauucaggaguuucaaagcaaaggcugacaugcuaucacgauuucacauuagaacuguuuuuuaaauuaggaguauaacagacugauuuggggauugugugucaguuuaacuuuaaauucuuguuguuuugguuggugucacaaccuuaaugucaacuuuucaaauagguuucuacauuuccuuugguucagggucauuaaaaaaugcaugugauaaaucuaagaggcauaaauaggucauacagaaguggaauuccuugcuccucuggaggugagagacagcuaauuuauaaauggaaaacaguuagcuuaggcauuuucaguaaauuuuuguuuuucaguauuugauuaagaaaaauguaaacccaaauaacaagacaugacguugguauaauucuguucaaauuuuauuccucuuguaccucuaauccuaaugauuugaucuuguugguguuaucaccucuauagauauaaagaaccacauguuucacuauugauuuuuuuuucacuaaaagcacagguuuaauuucauuuugugaaugcuuauuugauauaauugaguacagguaagcccugccuuggaaacuacaucugguaguccuuuauauaaagcauuguuaugcagaguuuuugguaaaaucuuauuauuuuaaaguaacacuugucauagaaaguaaaaugaaaguaaaaucuuauguguuaugcauuuuuuuuuuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucucccgccucagccucccgaguagcugggacuacaggcgcccgccacuacgcccggcuaauuuuuuguauuuuuaguagagacgggguuucaccauuuuagccgggauggucucgaucuccugaccucgugauccgcccgccucggccucccaaagugcugggauuacaggcgugagccaccgcgcccggccguguuaugcauuuuuuaaaaaaccuaguaccacagcagacaaaggagcagccaggaacaccaaucuguaaggaaagagaaacgggagagaagaaagaauaauccacucacccagaucccucccuuuuccuugauucuuaaucugucaugauuuuacagggcaggucuguauugccuauguuaaaucuaguuuuaauuuagaaaaguaaauauaauagaauuuauaccacaguuguuuuuuugaucaccuauguuggaaaaauaaaagauaaaaggauaggcaaauuauuuauugacuuuuucuugcugacucuuaaagauagccaccaaccaaaaacacuuucuagcucucaucuucuucuugauugaaacaccuggcucugguuuuaaucaaugacuggguaaacauuagucuuucuuuucuaauguacuccauuccuucuaugucuuuauuuuucaacaauguugaaauaaauuuccuacaguuuucauugggaaguuauuaugaaauuuuaucuucauuugugguccuaacucuacuuuuccuacacauuggcuucucugauauagcauuauuauuaaaucaccacauuuuugauaaauaauauucuuuuaagucucaguucucaaaggcgagaaguaauuguguugcaauguauuuaaguuugaauauguguacaguugucugugaaggcauugauuaaauccucugaauuuauuuaaacuauagcaguguucuuccuugaacaaauauuuaaaaucauuguuauuguugcuauuaauacuaguacugacauauauuucauugaaauaaaauuuuuuaaacuaaaaugccuguuuugaaauucagaggaagcuauucaaauaaaugaauuggaacucaguguauaccugcaauauagaaaaguuuucuggcauagaaacaaaauaugcucuuuaaauaucauagaccaagccagcuuuaugcaaauucauuuagagcacuuucagauuuauguauuuaauaaagcuggguagugguucuaacuuacguauuuaauguccuucauuguacggugauguucuugugacugccuggaaaagaaugaugacauuuuauuuaguguuucugccagaucaaucaauucuauaaauggcuuucuaaugggauacaauauaugcuuuuaauauuuuucaauaacacuaagagauaacauuuauugaguucuuucuaugugcuagagacugcucuauguacuaucuauggauuaucccauguaaucuugguaacaacccuuuaauguucucacucguuuacggauguaguagagguauauaaggagaagguuauauaacuaguaaguaauggagcugggacugaaacauaagcaguguguuucugggugcaguggcucacgccuguaaucccagcacuuugggaggccgaggugggcagaucacgaggucaggaguucaagacaagccuggccaacauagugaaaccccgucucuacuaaaaauacaaaaauuagccgggugugguggcacgcuccuguagucccagcuacgggggcggggcugaggcaggagaaucgcuugaacccaggaggcagagguugcagugagccaagaccaugccacuguacuccagccugggugacagagucugacucugucucaaaaaagaaagaaacauaagcagugugacuccagaguuugaacucugaaccuuuccuacucaaaauauaaucuucaggccagcaguguuaccaucacccaggaacuugcuacaaaugcagaaucucagagcugcugaaaaucugcauuuuuaacaauguacuuaggugacuggcacaugaaaaauugagaagcacagccuguaaaccacuauacuauucugcccuuaaauuuagaauuaaguaucuuuuaaaauacauuuuuauuuuucuguaugaugcugaauuccuauuugaugcuaauuuuggaauuccugucauauuucaagagcauuauaaugagaucuaguaacuaaacauaagcagggaugcaagguagucacaauuuaucuuaaaaucaauuguauaaagaacagaaaaaaaacauaaacagaaagcauuuauauagaggcagguaauuguuccaacaucuaagacuuucuuaaaauccuaguguaucccacugucuuugaauguagauucuggagacaggcugccugguuuugaaucucaccuccuauuucuagcugugggaucucaggaaaauuauauaauucuauaccucagcauccucaaaugaggucuaaagccacagucuacggaauuguuguaaggauuaaauuaguuaaugcauauaaaggauuuagaaggaaaccucuaaugagauaagugaauaaauauuaacuacuguuguucuuaccuguuauuuccaucuuugaauugaauagauucacaucucauacuucuuggcuaucuauuggcaagaaguugacaaauacuuuuuguuagcagagcucaccacauaaagggauaucuuugcuguuaagaguccaaaccacaaaccucaguuuuuguauuuucugaaaacugucuuccuguggcacuuuuucuguuugugaguucugcuaaaugccacuugauuaugauaauuaaccaguuaaguuuagugcaauuaguucaaaguguucaaagucaaaauggaauguguuaacaguauguuguaauuuuaaauauacaugcuucuaaacuaaguaaaaauaaugaguaugugaguccauuuggucaaccucuuacauaaguaauacagaaaaauaaagaauauuuguuuaaagguugaauggucuccaaucugguuuguuucuuucuggaugaacauaauucugaaaugaucaugauagucuuuaggggaauaaugguuugguguacaaguacucaccuaacaacuuuucagaaauauaccuaugugugaagugaguuggcauguuuuuggaaaguaccacuuugaaagcugauuuguaaaaggaauugagauaacaauacuuaguuaaaaggaugcccugggaaacuuuucaauugccaaagagaguuuaauucacuaggucugggauggggcccagguaucugaauuuuuagcaagugucccugguauuuuggcuuaaauuaguuuuggacuacacuucgaaauacccugcaguaaagguaaagacagguauugaaauaagcuuuuguugacuucacauucauuuuugcaacauuguccucuuugauacugucuuuguccacccuaugaccugauuuuaucuauccuuugucucuuuucccacucuguuaguagcucgcaaccauucauuuucugguuuuuuucuuuuuuacauuuucuuaaaaauaucucuucuggauuuuucaaucauagcuuuacagaugguucuauaaaaugaucauaaaugucucuuuuuaaucuaaaaaucucuaagccaaacuauagaugcugaaaucaacuuagaagcuauaggcaguauuaaaaaggaaaaaaaugaaaaaaugaaaagcaauagaauagaaaauguaagagcaaguauuaagaguaaguaaugcuuugugaagcuuucuuuugagauauguguguacacacauacguuaaauugcugugcaucuuuuaaaccagugcgucauuauccaacaaauugaacaaaauuuuuuuuuaagaagaguuaaauuuuuucuuuuaauuauaacuaaaaucuuggucaucucauuuauuagcucuguaacuuacauauuuaaggagauguuaguagacaacuauuauaauuuauaaauguaaggugccauuauugaguaaauagauucuuccgugaguagaugucucuucucucaccaaguaaugaagcagcaauguaaguuaguuuaguuuuauuaguacauguguauuaguccacuugcuguugcucauaacagaauaccugaaacuggacaauuuauaaagaaaaggaauguauuucuugcaguucuagaaacugagaaguccagggucaaggguccacaucugguuagaggcuucuuguuuguggggacucuguacauagaguccagaggugauacaggguaucacauggugacguggcugagcaugcuuguucaaaucucucauucucuucuuauaaaaccaccgucccacucccauuaaucuauuaacucauuaaucuaguaauccauaauucaugcauggauuacuccauucaugagggcuuugcucucaugacccaauaaccucuuaaaggccucaccucucaauacugccacauugaggauuaaauuucaacaucaguguuggaggggacaaauauucaaaccauagcaacaugauacacugcuauaaauguugauucucuuauucacccuuguguuuauuuuguauauauguuaagguuuuuuuaaagauugaaaaauaauacuuuguuaugauuggcuacaucuuagucucaugaacuauagugugacaucugagcacuaucuuuucucaugcauuucucucacauaucaccuuccucuguauucugaacauuuccacuuguacggccuacucaaaaucauuaugucuaacacuaauuugcuaugccuucuuaccacuauuuuccuccuaaauuuuuaaaaucuauucaugagcuaccauucugucauucagauuaaacauaaagaauuuucuuuguaauaauuuaucccuuacugcauaaacuuccuuauagccucaucuuucuacucuggucuauccugggucccuggccugcagaaauccuuaugggcaaacauaguagucacccacuccucagccaaaggccggcauguguaugcaauguaugguaucuauggcugccuuuaccaagaccagaaaagccuuugauaucaaauaugcauugcauggacaauguccaccucuuuauuuuagucacuacugucauaauuggucuucuuccacgcugauuuuuauugcucagggagaaccauacuuuggcuuuacuauugcuaguuucugauaauguaauccaccauccuuuugccucuuaacaugauuuuauaauuuucacaugugcccuguuuaguuucucuggugaauugggccugaagcccaagcuuguuugugccugaacauguaacagcggccugguuuucucugaguuguaacugucugccucacucaguggccccaagcuaucuaucauauccuggaaagucauuucagaucuaucuuuuuuuuuuuuuccgucauggccacauccucuuccuauuuaucaucaccuucauaucuacuaauuaucuuccuaauugaucuuccucucucuguugucucgccccacaccaaaccaucuuaacaccuuguuuuauaaauauuuauaaaacacuagucgugugcugccuuaguaaaaaaacauuuuugacucccucuuauguacaggauaaaguccaaauauuuuccuccuagagagaaaaaauaaaaaggccuuaaaauaucuguccauagcauaccucuucaauuuuaucuuucacuauuuucauccaugauuuuucugcucugguucuccaaaacaguuccauugaugccccagggauguucucaucacuuuaauuacaagggcccccaguugaugguaguccaugaaacuggagcagguagcugugaaugggguuuaagagugggaucccaguacauagaaaugucaagaugagaaccagagccggguauaguagcucauacuuuuaauucuagcuauuugugaggcugaggcaggaggauugcuugaguuuaaaaaguucaaggcugcagugagcuuauacuggcaccacuguacuccagccugggugacaaaguaagacuuugacucuaaaaagacaaacuaacaaaaauuaauuuaaaaaaaaugaagacauaauuauauauuggcaauaaucaaguuaguaagagcugagguugugaaacagcagggagauaagcagacugacacauuaucuacuucuaaaguuaaugucugggacuucuuauguccuuucuuuuuuuuucuuuuuuuuuuuuuuuuuuuuuugagauggagucuuacacugucacccuggcuggaguacaacggcaugaucuuggcucaccgcaaccuccccaucccggguucacgcgaugcuccugccucagccuccugaguagcugggauuacaggcauacaccaacacacccgacuaauuuuuuauauuuuuaguggagaugggguuucacuauguuggccagacuggucucgaacuccugaucuugugauccucccaccucagccucccaaagugcugggauuacaggcaugagccaccacgcccggccauccuuucuuuacuaguuguggaucguuccucaaguuggagagggcuugaaccuauguauagugagagauuaaaaugucuccaacuguggggccugugaagcuauggauauuggaagaucacuggcucccaaccuuuaggaaauccuuugccuuccuuuuucuuggggcuugccuuuccuaucuccaucugcccauagggagcucccugcugcaggacugcuagauuauuugauacuuguaucacucaguugauacaccauuagcuaaugccuuguaauauuuaugaggacuaaggucugauuuuuuuuuaucuugcccaaauuucuaagaggucuggggagucaugcccuacaaaccagaaauucuuaucagauggguuuuauuuaacucuauauaucaugacuuuccaaucugacucuggauaacauuacaagaaaagaaagaaaagcaaaauauuuuaccccaaaacauguuucccugccauauuuuaaauggcccugcaaggccuuucuuugugggggaauaucugcaucuguaaagaaucucuauuaacauagcuagaucuuuuucuuccaggcccucccaauccugaagagauuaacuaaaagucuagcaccuuuuaaagaucugaauaggaaacauuugucaucuguugacucuaacagcagccacuguaaaauuuccaaaagaggcugggccugguggcucacaccuguaaccucagcacuuugugaggccuccgcagguggaucacuugaggucaggaauuugagaccagccaggccaacauggugaaacucugucucuacucaaaauacaaaaaauuagcugggcaugguggcacaugccuguagucccagcuacuagggaggcugaaacaggagaauuccuugaaccugggaggugaagguugcagugagccgagauugugccacuguacucaagccuggaugacagagugagacucccucucaaaaaaaaaaaaaaaaaacacuuaaaaagaaccuuggucuccauaaucuuuuaucuuaaccugaacauuuccuuucuaucaaucccaggucuuuagacaaacucaaccaauugucaccagaaaauguguaaauuuaccuauaaccuggaacaacccccccaacccccccaagcuuugaguugucccgcuuuucugaaccaaacuaauguauuucauagaugcauuugauugaugucucauuucucccuaaaauauaugaaaccaagcgguacccugaccaccuugggcacauguucucaggaccuccugagagcugugccaugggccauggucacucauauuuggcucagaauaaaucucuucaaauguuuuacagaguuugauucuuuucgccaacacuuauuauauuguucuuauucauuuuuuacuucuuaggugucaaaagugagacacucaucauaucaaacaaaaaucaauuauaaagaauuaaaauucccuuucugcugucccuuuuuaauucuaucacccacagauaagcacugcuaauaguuuaguguguauucuuuauuuuaugggauaguuuguuuuuucaaaaauauccuguauuaugcuguauauauaguucuacaauuuuuuaaaugaaauaauauaauauucuggaaaucuuuccaugucaugccauagaaagguagauuauaauuuuuaaugaauugcagauuuuucguuuuugagugaaguauuauuuaacaguuauauauaaauaaaccagaauagguuuagguugaccuauacuguguacuucuaaauugugacaugguucauaugugagucugcaguguaaugaaugaagcucauacuuuaacauguggcuaaauugccaauagcccauuuuucuuuuuuagauccuuuccagaaggauuguaagguaaaacauauuuuucaagaacagcaugaagggugcuuacugauaaagugaauacacucagacaugagcaguuagguacagcuaacuccuucagguuugggugaugguaguagcagaaguacuuaaugcugccagcccugcuggccaguugaugugcccgugcccuggucaguugauuguacauuucccagucuuuauuuacucuugccauagagugaauauaguccaaacuugguuuuuuuguggggcuuuuuuuuuuuuuuaagagauagagucucacuauguugcccaggcuagaaugcaguggcuuuucacaggcacacuacuagcacaccacaggcuugaacucuugggcucaagcaaugcucccaccucagucucauaguagcuggaacuacaggcacaugccauugugcccggccacuaaaaagguuuuguuuaucauguaucauaugguauaaaacuacaacuacuuauuuauuuuauuacuggauaauguauuuuuauuuuauaauaauccuuuuuagcaacagugauaacaaaacaaaauaucaguguacauuuaucagacaauacugaauuuccuugauuugcuggaaauaauucauguauaacucucauaaaauguuuguugacacuuaccauccaccaugaugacucuguaaugguauaacugaccacaugaaaacaagacuuaaaucugugaaagaggcagcaacaucuaauacacaguuuuauuuuaagaccacaucuaaaaauauuaccuuuuaauacuuagccacagaagguacauuuguauaccacucugucaggcaugacuucauuuagaucaagugacuguucugaauuaauuucuuuuauuuuuaguuucaaguuuucuugugcaugugugaaaagugaaacaauagcuguuaauguauucacuccauuagaagaacuucaaucauuaaauuaugucaguuguacgucaguauuacuggauacuucuaaauguagaaaaucaauuaauuccaauaauaaugguucaaauuucuuaucuaauuccuuaaaucaaaguaaaccauuugaaaguucauucuguugaaguugaaacacuugacaguauugugaauauuauuguaaauuaaguuacaaacugcaacaucaaugauaaaauuauuuucucuugguacuauuaaaaauauauuguuguggaacacaacaucauauaaaugccuucuuuuagcaaauuuagaaccuguggggaaaacuauacuugaaauauguuguaaugcacacaguaauucauaauuacauccccaaaaucugcaauauucuaccaauccaaguggaagauguaguugucaaguacaaauaugauuauacauauacaagguaaacagccuauaaauguucaugauuagacugaaguugaauaaaacaaaaauaacuaaguaugacaugguaauauucaugguggcuggcaguaaugcacgauauacaugguggccauugauggggugggucaauacuugggugguacucaaauuugcuuccccaugaaaguacagagaguaguuuaaauuagaaucuuagcuuugggugcugauggugaagucaaguacuuuuucucugauuuguccuuggaaggaagucuucauuuccaguuuacaagaccgguguauugguuuauacuacaggggcagguccauuugaguauuuuauuuucgauugaggagguggcugguaugaggauuaaaauugucgugaaguauaguacggaugcuacuuguccgaugguagugaagggguaguucacugguuguccuccaauucagguuaggguaagaaggucuguggcuaggaaucaauauaggaauuggcuuaaugggugaaauauuaugcuuuguuguuuggauauguggaguauaggaauugcugcuaggaugaggauggauaguagaagggcuagaaugccuccuaguuuauugggaauggaucggagaauugcguaggcgaauaggaaauaucauucggguuugauguggggugggguguuuaggggguuagucaggguguaguugucugggucgcccaggaggucuggugagaauaguacuaguguuaauagggugaggaggaaaaggaauaggccuaggaugucuuugguuguguaguaaggauggaagguaauuuugucggaaugggaggggaugccuaagggauuguuugauccuauuucguguaggaauagaagguguaggguuguuaaggcuguaauaauaaagggcagaaugaaguggaagguaaagaaucgugugagggugggucuuucuacugaguagccaccucagacucauuggacuaggucuguuccgauguauggaauggcggacaauagauucguaauuaccguggcuccucagaagaauauuuggccucaugggaggacauagccuaugaaggcuguugcuaugguugugaauaagaggauaauaccaauguuucagguuucuagguagaggaaugagccauaguauaagccucggccgauguguaggaagaggcagaugaagaauauugaggcaccguuagcguggagguagcggaugauucagccaugguuuacgucucaggugaugugggcgauugaugagaaggcgguugaagcaucuggugauuaguguauggcuaggaauaguccugugaucauuugaaugguuaggcaggcgccaagaagugagccgagguuucaucauguggagauguuagauggaguggggagaucaauaaaugagugguuaauuaauuuuauuaacgaguugguuuugcguguuggggucauuaguguucuuguaguugaaauacaacgaugguuuuucauaucauuggucgugguuguaguccgugcgagaauaaugacauaugcuuuauuuuuguuaagugugguuuuaguaaugggguuugugggguuuucuucuaagccuucuccuauuuaugggggcuuaguguugauuguuaguggugugguuggguguaucauuauuuuaaauuaugggggagguuguauagguuuaaugguuuuuuuaaauuuauuuaggggguauaaugguuguuuuuggguacacuacagcaauagcuauugaggaguauccugaggcaugggggucagggauugaggucuugguaaguguuuuagugggauuagcaauagaagugggguuaguguuauggguaaaaaaauaugaugggguggugauuguggugaauuuuaauaguguaggaaguugaauaauuuaugaaggggaggggccagcauugauucgggaggauccuauuggugcgggggcuuuauacgauuacgggcauugauuggugguaguuacugguugaaccuuguuuguugguguauauauuguaauugagagugcucgggguaacagguuaugugauuaggaggaggguuaggaggagugggaagaagaaagaggaaguaaaguuugauuaugccuuuuugaguugaggugaugauggaggcggagguuugguacugugagguuguuuuagguauuaguuuuucuagucaaguuaggucuaauaaaaguagggauaaauuuuggcuuaugggaaggcuuaggugggggauugugcggugaauaauacagggauagaauccgaguauguuggaaaagugaaauguacacaguggguuuuuuauuuugaguuuguugguuaaguaguugaggucuagggcugucagaaguccuaggaaggugaugccuagggcugugaguuuuaagugaagugggauugucauuugggggauggauguggggaaaauguugcuggugaugagaaauccugcgaauaggcuuccgauuguuaggcguuugauggggcuuagcaggguaggguuguuuucguugauguugguuaggguugggaaacgagguuggccuguuagggugaggagaauuauucgagugcuauuggcgcuuguuagggaaguggcgaugagaguaauagauagggcucaggcguugguguaugauauauuugcgguuuugaugaugaggucuauggaauagaagcccgugaggaagggcauuccugcaagugccaggcugccaauggugagggagguugaagugagggguauaauuuugaguaguccuccuauuuuucgaaugucuuguucauuguugagguuaugaauaauggauccggagcauauaaauaauauggcuuugaagaaagcauggguacagauguguaggaaugcuagguaugguugguugaugccgauugugacuaccaugaguccuaauuggcuugaaguagagaaggcuacgauuuuuuugaugucauuuuguguaagagcacagacugcugcgaacaggguggugguggcgccuaggcauagugugagaguuuggauugguggguuauuuucugcuaagggguggaagcgguugaguagaaagaccccagcuacaacuauggggcuugagugaaguagggcugagauggggguagggccuucuauggcugaggggagucagggaugaagaccuaauugagcugauuuuccugcugcugcuaagaggaaaccuaguaguggaauaaagucaggguuaguguuuaggaggaguauuucuugugguucucaugaguuggaguguaggaggaaucaugcuagggcuaggaugaagccaaugucgccaauacgguuguauaggauugcugggauggcugcuguguuggcaucuguucgagcauaccaucaaccgaugaguaggaaagacaugauuccuacgcccucucagccgaugaagaguugaaauagguuguuggcggugacuagaauuaguauggugauuaggaaaauaaguagauauuugaaaaauugauuaauguuugggucugaguaugacacuaugcacuuucuuuuuggauuuuagaaaugucugagacuuuguaaaucaacuuaaguguuccaucaugguauuaaacauuuuuguaaaaaugaccucuaaauuuuggccgcaguuucuucagaauccauuagaaauauuuagucaaagcauucaacaaauggagggcaaaauauucagcuuauguuaagcuuuuaaggaauugcaauuauugaaaacaaaccuugcaaaugggaggauauugaaauauauccucaugaaaucaaagggacaauugaacaaugauaagcacucaaauuacaugcaagauuuaauugugaaauucccaauuacgcuuugaaaugcccaagacuuauggggaaaaucuuuugauagagaugaaguuuucuauuggauacauuuacauucugauccagaaugauguuaaacugagaaagguuaugguuuugcagcacuuaaauuuagcaaaccguucaaaauaaucauuaacauuuauuugaugaguuuugucuuuuaaaauuuuuggucaaagaaaugcaaucugcauggaggccaaaaaaaauaguaccuguaaaaauauuugagcuaaaauauuuauguauuucauuacuaaaaauuaaaauugagaauguacuucaucuagcaaaauuuacucugaacuuaauaaauuuaccaaguagcuuaucaccugagagagaguauuuucucaauuaaaaauauuauaaucuauauagaagagucuauucaugguaugaacaauuuaaaauuugcuaacuauaaaaugaaacuuggaaaaauauaaaaagaauagucauauuuuuaaaaugcauuuuucaagaaauaucuguggaugacagauacagcuaagaaacucauuaaaguaugcaaaaauauaucaagaaucauuauuuauuuuucaagcaauauaaagauguuuuuacuuuugaaagcaaagauauaaauuuuuugaaagaauauuauuuuuaaaaauaguguuucaauguaauuaguuuguaggucagcaauuauauaaaacuguuuaacugguuaguaauauguguuucaaaaaucauauaauuuuaauaauuuuugguaccugcuuuuuaaucucaaaaaaguccugauuuggaugauaauuuauauggacauuuuauguaaauaugcuucauucccuccuucucacguucaguuuccccuuuucuaagugcuuccuagauauauuucuuguauuucaaagucauuauucuaaaaugaacauaccaccucaguguccauuaacagauuaauggauuaagaaaauaugguauauauacacaauggaauacuauucagccuuagaaaaggaaauucugucauuugcaacaauauggaugaaccuggaggacauuacacuaagugaaauaagccaggaacagaaagauagauauggcauguucucacuuauauguggaaucucaaacaauugaacugauagaagcagacaguagaacgauguuuacaagagccuggggaauggggagaauggagagauaugggucaaaggauaaaguuucauuuagacaggaagaauaaaugauaaguauuuaaggcaauggauauguuaauuagcuugauucaaucuuuccacacuguauaccuaugucauaaaaucacuuuguagcccauaaauauauucaauuauaauuuaucaauuaaaaauaauuuuaaaaguaaaaugaaaugaacacacuauuuccccacuacaaacuaccuucuucugauuuucucuuaagagucuaacuuuauucccagucagaguuaaaauuuugcagccaggugcgguggcucaggcauguaaucccagcaguuugggaggcugacggggguggaucacuugaggucaggaguuugagaccagccuggccaacauggugaaaccccaucucuuguaaaaauacaaaaauuagccagauaugguggugggcgccuguaaucccagcuauccaggaggcugaggcaggagaauugccucaaccugggaggcagagguugcggugagcugagauugcaccacugcacccagccugggcaacaaaaggagauucugucucaaaaaaaaaaaaaaaggaauuaaaauccugcuauaaacauggauuuuuuuucccuauguuuuagaaagaucauucuggcagcagauagagaaugaguuagaaggugauguugcaaaaaaacagggagagaccaggcaugguggcucacaccuauaaucccaacacuuuggcaugccaaagcaggagguucccuugggccaggaguucgagaccagcuuggacaacagugugagaccucaucucuaccaaaaaaaaaaaaaaaaaaggaaagcaagaaagagagagaaagagagacaggaaagaaagagagagagagagagagaggaaagaaagagagagagagagagagagggagagagagagagaggagaagagaagagaagagaagaaaaagaaaagaaaagaaaagaaaagggagggagggaagggaaggauggaaggaaaagaaaagaaaaaagaaaagaaaagagaaaauaaaagaaagauuuagaaaacugcugcacuaauccagaugaugggguuugaacccugcacagggauaaguugaaccuaaagcugccuucuuacauauuuuaaauucgguuuccucauacauagugaacaguaaccuaacuggauauguaaacagacucuaaccuacucuuguaacaaguaguagcccaggagcaguugcucgugccuguaaucccagcauuuugggaggcugaagcaagagguucgcuugaagccagaaguuagagaccagucagggcaauguagggauaccucaucuccaucacacacacacacacacacacacacacacacacacacacacacacacucaaaaauaaggcaugguggcucaugccgguagucgauaccucaucuccaucacacacacacacacacacacacacacacucaaaaauaaggcaugguggcucaugccgguagucgauaccucaucuccaucacacacacacacacacacacaaauucaaaaauuaggcaugguggcucaugccgguagucacagcuacuugggaggcugaggugggaggaucccuugagcccaggaggucaaggcugcaguaggcuaugaucaugccauuccagccugggugacagaaugagaccuugucugcaaaaaaaaaaaaaaaaaaacaaggggaauagaaagaaaaagagcugguaaaggaaccugaguugugguauucaagauagaaaugguagaaaaacagugcucugagagccaauggauuagccuuuggggaagaaagaaagcggaacuagugucaaguauaggagguuggagggaagacugacaucagauaauuuugagguucugauaacuuuaggaggaauucaggccuaacuuauaaaggaaaugcucagggcaggcacuauggcucacgccuguaaucccagcaguuugggaggcugaggcggugggucacuugaggucaggaguucgagaucagucuugccaacauggugaaaccccaucucgaacuaaaaaugcaaaaauuagcugggcaugguggcaggcgccuauaaucccagcuacucaggaggcagaggcaggagaauugcuugaacucgggagguggagguugcagugagccgagauugcaccauugcaccccauccugggugaaacaguggaacucugucucaaaaaacauaaaaaaaauuuaaaaaaggcaaugcucacagaaauguuuuacaguuggaaaguuuuagauuuaacuuuaauaaauuaaacuucaaagauacaauugucauuguuauaguuuuacacuguaacuuuuauucuaauauuucucuacaacuuauuauuuauuuuuacugugaacuuuuuuuuaguuuuauauuguguguacaagggcauauugaucuauauugaguggacuuugauaaccugucaagaacaucaguuucacuauaauugacauauagaacuuuucuagaaaucugacuuugaaguugagugaauccaaaacaucuuuuuuuuuuuuuuugagacggagucuuacucuguugcccaggcuggagugcaguggugcgaucacggcucacugcaagcuccgccuccuggguucacgccauucccuggccucagccuccggaguagcugggacuacaggcgcccaccaccacgcccagcugauuuuuuuuuuuuuguuuuuuuugguauuuuuaguggagaugggguuucaccguguuagccaggacggucucgaucuccugaccuugugauacacccaccucggccucccaaagugcugggauuacaggcgugagcuaccgugcccagcucaaaacaccuuuuaaaaucucuuuagauuucaucuuagaaccuguuucucaauagugucuacggguaaaauuuuaacuguuuuaugauuugacuuauuagcuguuacuuuucagaauuacgucaagaauguguucuagauauuuaaaauuuauuuaauaguuaaagcacuuaauuuaaguaguuucuccccugcagucuauaccuacauacuaucucuuacauguucauuuugaucccucagcuuugguaugugauucaucuguuaguaaauaaaugcuagguucuuuccucucaauuacagucauuggucugauaauccugugagucaaucugcacgcaacaaggagcucauaucaaacuccuggcagguuuaguuaaaauuaaaaugcaugcuuaacuguagagauugucaaguguggaaauaauauuuguccagcuggacagcuuucuuuuguaguugcuaaaugaaaguugagauucugucugcuccuugaaagcuucugugucaugaagauaauuugaacuguuugugguuugacagggauuauuaaaaucagaugaagugaagggaagcaagugugagaaagcaaaauugacacugacacucucuauuauuugcagcuuggaucaugaugacuauguugauaugauagauucacuguugagauaaguaaagcagcaaauaaaauaaaaagccaguauagugauggauuuuuagauuuaauuugaagaaauccaaaauuuacuuuuauugauuguuuuuaaaauagauuuucaaguuauuucauaugaauuugucuuaaccacugacaaauuauacuucuauugaacuauagaauuaaaaaguauacuacaaaggcuguaugacagaagauuaaauauuaaagaaguagaucacaugauuaaaucauagaauuuuaaaacuagagaguccuuaaaaauuguuuuuaucuaacauccuuuuuuuguagaugaaaacuaaaaagcauuuuaagguaucacauuuaaauuuuaauugauagcuuccuaccuuucacaauuuuuuaaaaauggcuuacauaguuuaaaagccauuuaaaaauuguuuaagccacauucguaggugacuuuuuucuguuuaauaauacucaaguuacguuauuauaguuauauauagccuuuaaauaguauuaucuacauuggugaaauaaaugccuuucauaaauaugauuuucuacugagaacauuauuaguguagaggaaguuaugacuagaaggcuauuucaagaugucagucaagaagggcuauaguagaaaaauauaauuauuuaauuggaauaggaauuaaguuaaauaugaggaacuauauguauauaaaacaagaugaguuuuucuaugcauuguggaaaauccuguguuuauuuauuuaagcagaguagugaaaugaucagauuaaauguauaaaaugagaagcguagaguccauaugcaagacagacaucaacuggguguccuacaauucaauucaaauucaauucugacacuaccaggaccccacaaguucagagcucagacccauaagacugcccucacuucacgugccagcugcagguggguuucccagaugacccacacuucugccacaagacaacaaauuuggggguugccacaguucaauaauucauuagaaugaugcacggaacucagggaagcaguauacauacaguuuuauuagaaaggauacaauguaggaacagccaaaugagagagaugcauaagauaaaguaaggaagagguuuauggcacagaacuuccugucugggugugccauccucucaagacauggauguguucaccaauuuggaaacuuccugaaccuccuuguuuaagaauuuuuauugggauccauuauguagacacgauugauuaaaucauuggccauaggugauuggucucaaucccaagucccuuuccugucucuggagguuagaguuagagggaguggagcugaaaguuaaugcaguaaucaaaugguugguuuuuuuagacuagcucccauccugaagcucucuaggggcccuccagaguaaccucauaaauauaaaaucaccugugaauaacaagagacauuucaaucacucaggaaauuccaagaguuuuuggagcuauguuccaggaagggggaaaggaguuaaaaccaaauguguguauaugugcgugugugugugcugugugcguacacgcgcacauguauauaauuauaccacaagaugugagucuuggaagucagaugggagguuuuucagcaagaaauaauguccaaaucugcgacacugguugcagacggagguaaaugucaucuuugagagcauuuggugaccauuuaagaucuuacggagaaaaaguauccaagaacuuggugaccauuuaaaacaggggucagcgaacauuuucuauuaugacugaaauaaccaaaaggccagauaguaaauauuuuaggauuuguggacacauauggccucuguagcauauucuuuuuuguuugauuuuuauuuuuacaacucauuagauauguaaaaacuaucaggccauagaaaagcaagccaugucauaguuugcugauacuugauuuaagauacuagggcaagaaacagggcaauuagguaaaugguuauccuguaagguaggaagagaagccaguguaaggaaaagacucugaauuaaauuuuggacauacugaguuuucguuggcccucugaagguuugcugaaaauaauuacugacaugaggcagauaagugggagaaaagacacaugaauuuauuuuuguguauauacaagagccuucagaaccccuaccccucccaauaagagcuuauauacuaucuuguaguuacagaaagaaugacagcucagagaauggccaagaauggguuaugaugguacauuaaguuauaggagggagagaagagguuugacuagccaagguggucuuguuauguugaugaaaccucacaggaagcagcccucagagaaaaaaugguaaauguuucuuuucagacuuuuagagguaucagacucugaguuaaucuuuccuagauccagacaagagaaggccuggcugcauuaaugcagauucuuuauggaugcauguuuuccucaaaaaagacagcuuugcagggccauuucuguuucccggccuucugacagccaccucaaaauaugaaauauauuuugugguaaaauauuuugauccccaucaugaguuuaaagaaccuucgaaucagugauguggaauugucugguaaguacuuggaaauauguaugggaguuuuggaggaaggacuauaauuauagauagagacuuugaauuuucaucauagagaugauagugucaagcugaaaugaccaaaaggaucauaauccaguuuuaaacaguuuauucaagugaaaaacugggaguagccauccaagaaacacagacuccagggaaaugggaucaguuaaaguuuugcuuauauagguaggaaacaaaauauauuuaguaagauuguuccauuuucuauacaaggcugguuuaugaguuacaacaauuuaauuaguuaguuuguuuucauuuccaaagaacuuguuuucauuuuguguccuauuuuaaagagaguauuuaacauuccaucuuagacagugugauagucaugaagucuuugcauagaaaacguaagagggaaguuaaucuauaguaaagaucaacaguuaggagagaagggaucuucccuggcacccuguaguccuuuacaacauuuuccaaaacaauauaaauuguuuuauugaaaacauaaaauaaaaguacucuuguaaaauuauauaaaaugcaguugauuugcuugaagaaagcucaguaaagguauuuaaaagaauacacguguagggaagaaaaaguaauauccuuucuucccaucuuaguuucauggcugaggauccuguaaguagaagacagauuaacaagagaaaagcauacaaauguauuugauuaaguuuuacaugacaugggagcguucagaaaugaagaccuaaggaaacagaacaacuuauguauuuuuauggacagucaugcagaaguaugauggaugacaaaaggcuaugaucuaauaauaaauugguggaauuuagcaagaucuguuuguuaugauccuucucugugugucugugucuucagagauaaggacauugcuuucuucccgguauagggaaugcacuuguggaaugaaggucuuaugaccuacuucaguggaagguggagaauucuuuuacaaucugcuucagagaagaaggggaggaagaaagucagagagacuuuccuguuucugcuguuuucucaagugccagaguacuccaaacuuugcgguaacauguccuaaaccucaucacaggucuagagagaacccuguggugaauauugguguuuaauggcagauaugggaaagaagccuaucaaaauauuuauuaauuuaacacaaaaaacuacugugguuacuuuaagggaaaaaaauguaaguguugggcaguggagcauggagaagauuuauuguguguaucucacauaaccuaaugaaaacuuuguguguaaucagggaagagcaaaaacugcaguucuaguggccucagccaaaaaacauucauacacaugcuuuugggaggcuggaauuaacuugacugguuuaccaccagugaugucuuaucccugccuccauuccaaauuucaaaauucauuuaguauacaucuaaguguuaccagggaguccuugcucccagagcucccaagaugguggcgggcuguuuccaaaaugguggcaggcugcuuccaagaugguggcaagccucauguucucugaccugggguucucagcuucacggauuccaaggaauggaaucuugggccaugcggugaguguuauagcucuauuagaagcugugggucauagaagagaaccguggaacgaagugacuaguguucagcucaauuaggaacccaggcacuuagcugugcaggaacaacggcaaacuuuuagccugaucaggagcggcaaugggcgccucccuggaucaggagcacggcagacacccugccagauccagagggauggaaguuagcagcgggucugugauggcagcaaaggcaguaguggacagcgagcaaaagcaccgcucgagccauaacaaacagggaccagaaaagagugcaguugcaagauuuaauagagugaaaacagagcuccuauacaaagggaggggacccaaagaggguagccauugcuggcugaaugccugggauuauaucuggaucauugucccuccugcugugcucucaggcgauagaugauuggcuauuucuuuaccuccuguuuuugccuaauuagcauuucagugagcucucuuuacuaccugauuggucacgugugagcuaaguugcaagccccauguuugaagguggauguggucgccuucccagcuaggcuuagggauucuuagucaacuuaggaaauccagcuaguccugucucucauaauggucuaacccuaaauccauuaugacuaggguuagaucccaucacacagaaauggacccucauuguauaucuguauguuguauaauugauuuaaaaaaaaaaaaaaaagaaaggagccuugcaugguggcucacguccauaagcccaguaccuugaaggcugagucauguggauugcuugagcccaagaguuugaaagcagccugggcaacauggcaaaacccaaucucuacaaaaauuagccaggcaugguagcacgugccuguagucccaguuaggaggagucugaggugggaggaucacuuggcccaggaggucaaggcugcagugaacugugaucgugccacugcacuuaggccugggcaacagagccagacccuaucucaaaauaaauaaauaaauuaauuaauuaaaaaagaaaugugaucuggccagcuacccaaaaugauguuuccuaccaggagccugguaaacagauaaauggugugagugacaagauggaaaacuaggaaggcgugcuauuuaggaagauugucaagagaggagacaauuucaaggaaggaguagcugucaguacugaauagugcaaagagauuaagcgugauaggaacugaaaaauauuuugucaauuucaguguaagguucgaggcagaaauuauuacucuggguugaggaguaaaugagaggugagaacacaggaaauguagacugcuauuuugagaagcugggauaugacaguaagggauacuaggguagguuuugcugguuucuaaaaaguaagaagcuuggacauguuuauagucugcugaaagggauauugaugauacaagacuggugauaauucauggaacaaagcucuggauggcauaaaagcguauuguaauggguagauguuuuaaucaaauuaaaguuaagcuaaauaauaaugucaccaauauuuuaggaaaauaguaccacauuaauaugacuugcuaauuaauacuauuaacauuuuaggagaaauuuuuaaacucuuggaacuuaauuuaagaacuuuaaauccuuuagaagaaagcauuuugauacaaagugcaugcuaaguucaaaucauuguuauuaaguuauuaaaagagaguuucuuuaaaauguaauugacaucuggcggggcauguggcucaugcucaugcucaugccuguaaucccagcacuuugggaggccgaggcaggcggaucacuuccagaccaaccuggccaacauggugaaacccaucucuaugaagcauacaaaaaaccaaaccaaaccaaaacaaaacaaaaacuagccgggugugguggcacacaccuguaaucccagcuacuagggaggcugaggcaggagaaucgcucgaauccaggaggcggagguuacagugagcugagaucgcaccacugcacuccagccugggcaacagagugagacucugucucaaaaaaaaaaaaaaguaauugaugucucauaaacuguauuuauuauuauucccaguugauacauaauacaaaacugccuuuuaaaaagugcuccauaacuuaaauuuucuacuaaugcagaucuucaaguuaauaaacuuuuacuauacuugaaaauucauuaguuaauaucauuaaucucaugaucugugacauuauuuaggucuaaucucaacagauacagcaauuuuaugacuuugaaaucaugugaaauauaugagugccaguuauaaaggaaugcuaacauuaaaauuuauauuaucuugguuucaccuuccauuaaagcaagagauggcuaggauugcauauugaaaauuauaaaguuauuaaaaugagaauauuauauagaaagagaacugcauugaaaaauaaagcaaugucagaauuggugagcaaaucacaugacaauuaauucuguuugcuugucaagcuacaauaguguauucugacugauccugucaauuucuacuucauacacacacauauauaaauaauuaauaggaguuacaguggaguaucuuauauuuuaaauggaggaauuuuaauagucauaguauauuaauacgaguacuuaccagauauauauagauaaucuaguuuacauaauuauaguaaucagaacuuccacaguuauuagcagaaagcauagcagucuauauaagaaaaucuaauauauagauaagaguugagaaaauaaauugaauggaauaacaaguucuuuguuuccuaauaugacuucaauaucuaaggguuuuaaaugacuaucaacaaauuaagauccacuggaguguuuauguagucauugggggaaggcuaaaacauuaaaaucucaacucccaguaauuaaugagaagaaagaaauuucaggcaacccuaaaauauuacaaguaagcucuggccuuuaaaaaagucgaugauguuguuuuuuauguuuuguuuuuuguuuuuguuuuugcaauuauguagauuucacaaugaaggacauuuauaauaguucuagggaaaacugucaaauguauauggcagaaaaauaaaucaacauauauaagagguaaaauauuaauuuuuuguaaaaguugaagucuauauagagaggcaauuuauagcauuaugauucaggacagcccuugaagcaauaggaaucccagcuuugccacuucauaucuaagugaccuuggacaagucaugaaccauucugugccucaguuuccauaucuuuaauaagauuauaauauuaucuaucuguuuauguuaagaauuaaaugaauucauauauauauauauauauauauauauauauauauauauauauauaguacacagaacaaugccuggcucauauaagugcuacaaaagagucggcuguuaucauuacuauuauuauuuagccauuuuagcuuuaauccaggucucaaugaaugagaucacugaauuacauauauuuuccaagauuugguaaaaauuaaauauugaauuuuuuaaucuuggcaggacuuuguaaaugauauaggaauauuacuuucugacuaaauaugaauggcaaaauaaaaaugagccaggccagaagaaaaggcuggugcauauuuaagaauggugaccgggucgguuuauuuucacuuugcuuuauuaccaagccagcaacacaaaccaaaccagcaauacaaagaauaauacaaauaauauagagaauauaaggaauaaauagaucaagaauacaugauggccugugaagguaugauucccuaauguuaccccuuuuccgugugauggcaugccauaaagaugucugaguuggucucagacaucuuuuguugaguaaggagucugccaagucaggggaaccugggaacaugagauuacugccucauagaauauuuuauggagcuuagaguuucagggauuauacaggggaucucuccuaucaccauagaagaauaucuugcugccgcacauuuuauuuuuucacaaauuauuucuugcuaagcuguagauucuacuucagcuuucuguguugugugccuagggaagggaaaugggaaaagucaaaaguggcucugacaguccaagggacaagaaaaaugguaguauugaugaacaaaauagucaaguccguugaagagcugauuuggguucagaaauauguccuucucaugcuguuucuuagagaacaucacgauuuuauagcuggaagaaaacugagagccuaaucuaccugccucauuuuuaaauuuuuuuuucuuuuuguuuuuuuuuuuugguuguuuuuuuaaacagucuccuucuuguugcucaggaaggagugcaauggcgcgaucuuggcgcacggcagccuccgccucccagguucaagcaauucuccugccucagccuccugaguagcugggauuacaggcgucugccaccaugcccggcuaauuuuuuguauuuuuaguagagaugggguuucaccauguugaccaggcugaucucaaacuccuggccucaggugaucgacccgccuuggccucccaaauugcuggggauuacaggcaugagccacugcgcccagccguaaauauuuuuuuuuuacuuuuuuuuuuucuuuuuuuuuuuagauggaguuuugcucuugucacccaggcuggagugcaauggugugauuucgccucagugcaaccucugccuccuggguucaagcgauucuccugccucagccucccgaguagcugggauuacaagcgccaaccaccaugcccugcuaauuuuuuguauuuuuaguagagacaggguuucaccauguugguuaggcuggucuugaaauccugaccucaggugauccacccgccuccgccucccaaaguacugggauuacaggcgugagucacuccgcccagccuuuacuuauuuuuuuauugacaaucguuguacauggguacauagugauguuucaguaaauacaacauauaguauucaaaucagaguaauuagucgauccaucaucccaaacauuuacauuucuuuguguugggaacauuuccuaacuucucuucuagcuauuugaaaauauauaguauauuauuaacuaugggaauuuuacagugccauagaagauucaaacuuauuccuccuaucuagcuguaauuuuguguccuuuaacaaaugacuuccuuucuuuaccccuuaccuuucucagcuucuacuaaccucuguucuacucuucacuucuaugaaaucagcuuuuuuagcuaucauauguaaguguuagcaugcgguguuuaacuuucuguuccuggcuuauuucauuuaacaugguauccuccagacucauccauguugccauguuucauuuguuucaagaaacuuaaauuuucuucauaauaucuuucuucacccauuggucauucaggaacauguuguuucuuuucuauguauuuguacacguuccaaaguuucucuuguugauuucuaguuuuauuccauugugauaagaaaagguacuugauaagauuucaauuauuaaaauauuuugagauuuguuuuguguccuaacauauggucaguccugaagaauguuccaugugcugaugaaaagaauguguauucugcaacuguuuagugggauuuucuguacauaucuauuaggucuauuuugucuguuuaaauccaauguuucuuuguugauuuucugucuagaugaucuuuccagugcugagaacgagauguugaagcccccaacuauuauugcauugcagucugugucuccuuuuacaucucauauuugccuuuuauaucuaguuacucagauguugggugcauauauauuuagaauuguuauauacuuuugcuaaaccgaucccuuuauuauuguauaaugucauuccuuuucucuuuuuagaguuuuuacuugaaguauuuuuaucugauauaacuauagcuauuucugcuugcuuuugguuucucuuuguguggaauaucuuuuuccaucucuucacuuucagucugugugucuuuacagaugaggguaguuuuuuugugggcaguauauaguugggucuuguucuuugauccauuucuauauuuuuugauugaggaauugaauccauuuucauucaagguuauuauugauaagugaggacuuacuccuguuauuguauuauuuucuuguuuauuuguauauauuuuuucccuuaauuucucucuauuuauuuuugcaguuugaugguuuuucuguaguguuaaaguuugauuccuuuuucuuucuccuuuucuaccagugaguucuauaauuuugaguauuuucauggugguaguuaccaucuuuucacauucagauguaggacucccuuaaguauuuaauauaaggccaauauaugucaaugaguuuccuuuguuauugcuugccugggaaagacuguuucuccauuucugaaggauagguuugcuggguguauuauuauuguccagcaguuuuuuucuuucaauauuuuuaauauauuaucccauucucuccaggcuuguaagauuucugcugagaaaucugcucuuaguccauuggggauugcauuaaauaugacuuaaugcuuuucucuugccguuuuuagaauuauuuuuugucuuugacuuuugacaauuucacuacuauaugccucagggaggaucuguuugaacugaaacuuuuuggggauauuugagcuuccuggaucuggauguucacgucucucccaggacuugguaaauuuucaguuauuauuuuauuaaauaagguuuguauaucuuuguccuucucuuuuccuucuggaacucccauaaugugaaaauuaguacauuuaauugugucccauaaacccugaaggcuuucugcauuuuuuuuucuuccuguauuauuucaaaagccugucuuuaaguucagguauucuuucuucugcuuggucuaguguguuguuaaagcuuuauguuauauuuuuauuuuauuucuggaauucuucagcucuaagauuucuguuuggcucauauuuaugauaucuaucacuuuguugaauuuuucauucaaaucacaaaguauuaucuugauuuuauggaauuaucugucuauauucucuuauauaugagugaguuuuauuauuuugaauacuuuuucuggcauuuuauguaguuccuugugauuagugucuacuacuggagaauuauuguguugcuuuuuuuuuuuuuuuugacauagagucucgcucugucgcccaggcuggagugcaguggugcgaucugggcucacugcaagcuccgccucccgggcucacgccauucuccugccucagccucccaaguagcugggacuacaggcacccgccaccaugccuggcuaauuuuuuguauuuuuaguugagacgagguuucacuguguuagccaggauggccucggucuccugaccucgugauccgccugccucggccucccaaagugcugggauuacaggugugagcuaccgugaauuauuguguuucuucaaaugugucauguuuccuuucuuuauguuugauaugucccuauguugauuucuucacaucugauguaauaguugccucuuccaauuuaauggaguagcuuucauagagaaagauuuauuccuauagaugggucuugcggugucaguuggguggggugcuuugacuuugguuauagguucacacaguaguguaaucuauguucaguuugggggccuuuccagguuggaugaaggugugcaguaguuuggccaguauaaaggugaguucacccuggggaaguccaccaaauuguuucucuggcuagaaaugcagguggcacagauugguuucccagcugugcaggaccagaguuuuaauuuuuagcuuccacagguaagugagcacauaugauguuugucuuucugugccugguuuuuuucauuuaacauaaugaccuccaguuucauccauguuguugcaaaugacaggaucucguucuuuuuuauggcugaagaguacuccauuguguauauguaccacauucuguuuauccaguccucuguugauguccauuuuaucuuuucaaaaagccaacuuuuuguuucauugaucuuuucuauuguuuucuuuguuucaguuucauuuauuuccacucugauguuuauuauuucuuuuuuuauacuaauuuugagucuaguuugcucuugcuauucuaguucuuaaugcaucauuugguuauuuauuugaaguuuuuguucuuuuuugauguaagcacuuaaagcuaugaauuucccucuuuguacugcuuucguuauauuccauaguuuuguuucuuuguuuuuguuuuuguuuuuugagauggagucucacucuguggcccaggcuggcugaagugcaguagcucaaucucggcucacugcaaccucugccuccuggguucaagcaauucuccugccucugccucccaaguagcugggauugcaggcaccugccaccacauccggcuaauuuuuguauuuuuuaguagagauaggguuucaccauguuggccaggcuggucuugagcuccugaccucagggcaucugccugccucagccucucaaagugcuggaauuacaggcaugagccaccgcgccagcucccauagauuuugguauguuguguuuccauuaucauuuguuucaagaaauuuuuuaauuugcuucauaauuucuucagugacccacuggucauucaggagcauauuauuuaauauccaugugaguguacaguuucaaaauuccucuuauuauuaauuucuuguuuuauuccauuguggucagggaagaugcuugauauuauuucauuuuuuugaaucuuuuaagccuuguuuugugaccuaccguauggucuuuccuuaagaaugaucuaugugcugaggagcgaaauacacugaaaaaauguauucuucagccauuggauaaaggaauucuauaaauaucuauuaggaccauuuguucuauagugcagauuaaguucaauguuucuuugcugauuuucucuuuguaagaucuguccuaugcugaaaguaagguguugaagucuccagcuauuauuguauugaggucucucucucucuuuagcucuaauaauauuugcuuauuauaauaucuggaugcuccaguguugggugcauauauauuuauaauugguguaucaucuuggugaauugaccccuuuaucauaauauaaugaccuucuuugucucuucuuacaguuuuugucuugaaaucuauuuugucugauacaaguauaucuacugcugccuuuuguuuguuuguuuguuuguuuccauugacauggaauaucuuucuccaucccucgguuuucagucuuuguguaucuuuauagaugaaauguauuucuuguaggcaggacaccacugggucuugguuuuuuauccauucagccacuguaugucuuuugauuggagaguuuaguccauuuacuuucagugcuauuauugauaaguaaggacuuacucuugcuauuuuauuguuuguuuucugguuguuuugugguuaucucuuccuucuuuccuuccuuccucucuugcuuuuaguuaaggugauuuucuacggggaucugauuuaauuucuugcauuuauuuuuuguguauccacuguauguuuuuuagauuugagguuacugugagguuugcaaauacuauccuauaacccauuaguuuagacuaaugacaacuaaacacugauugcauaaauaagcaagcaaaaagaaaacuaguaaaaacuuaguucaucagcuuuuuaacuuuucguuguuucuccuuaugucuuauuguacugucuacaucuugaaaaguuguuuuaauuauuauucaauucauucaucauuuagucuuucuauuuaagauaugaguaauuuacauaccacaauuacauuguuauaauauucuguguuuucuuuguucuuacaauuaccagugaguuuugugucuucagaugauuucuucuugcucauuaacaucuuuuucuuuuaguuugaagaauucccuuuaucauuuuuuguaggucaggucuuuaguugaugaacucugucagcuuuugucugggaaaaucuucauuuuuuccucaugcuugaagcauauuuuugcaggauauacuauuauaggguaaaagguuuuuuuguuuuuuuuuuccuucaguaccuuagguauauccugccacucucuccuggcuuguaagguuucaaagucugcugccagacauacuggagcuccguuguauguuauuuguuuauuuucuauugcugcuuuuacgauucuuuuuuuuuuugaaagggagucuuacccugucgugcaggcuggagugcacuggcucaaucuuggcucacugcaaccuccgccucccggguucaagugauucuccugccucagccuccugaguagcugggguuacaggcuugugccaccaugccuggccaauuuuuuguaucuuuaguagagacgggguuucaccauguuggccaggcuggucuugaaccccugaccuggcaauccacccgccuuggccucccaaaaugcugggauuacaggcaugagcuacugcgcccagcaggauucuuuuuuuuuaaucuaugacuuuugggaguuugauuauuaaaugccuugagguagucuucuuuggguuaaaucuacuugguguucuauaaccuucuugaacuugaauguugauauaccucucuaaguuugaggugccauuuuuaaaauuauuucuuucaauaaacuuucugccccuuucuuucucucuuuaaggccaauaacucuuagauuugcccuuuucaggcuauuuucuagaucuucuggccugcuucauuauuuuuuauucuuuuuucuuuugucuccucugacuguguauuuucaaauaggcugucuuugagcucacuaauucuuucuucugcuuggucaauucugcuuuuaugagacuccaaugcucucuucaguaugucaauuacauuuuucaacuccagaauuucugcuugauucuuuuuauuuuaaucucuuuguuaaaguuaucugauaaaauucugaauuccuucucugcguuaucuugaauuucuuugauuuuccucaacacagcuauuuuaaauucucugaaaugucacauauagguuuuucucuaggauuggucucuggugccuuauuuaguucauugggugaggucauguuuuccuggauggucuugaugcuugcggauuuuuuuuuuuuuuuuuuuuuuuuggugccuggacauagaauaauuagguauuuauuguagucuucacaggcugggcuuguuugugccugucuuuguugggaaugcuuuccagguauuugaagggacuugggccccaugcccaguuacacuaugguucuugcaaucuuauagagguaccaccuugguaaucuuugauaugauccaggagaauucacuagauuaucaaacagagacucauguucuccucccuuacuuucuccuaaacacccugagucucucucucucucucucucucucugugcugagccaccuggagcugggggugggguaauauaagcaccccuguggccaccaccacuagaacuuccuugggucagaccugaagccagcacagcgcugggucuugccuaagggcugcuguaaccacuaacugguuaucaccuauguucacucaaggcccuaggaaucucuauacaacagguggggaagccagugagguuuguacccucccuucagggcaguaaguucccccacgcuguagguggguucauagcuacugucuuggagccagggauuggagucaaaacccuuagaaaucuaucugguguucuguucuacuguggcuaagcuggcccucaaaccacaagacaaaguccuucccacuguuccuuccccuuuccacaggcagaggagccucacucuguggccacaaucaccacaggcccaaauggaguauugccaggcuacagccaauguucccauagggcccaagggcucuucagucagucagcuugucgugaauguugccaggcaugagacucacccuucaggauaguggacucccaucuggcccagggcagggccagaaaugccauccaagagccuaggccucgacuuggggaccucaagagcccacuuagugcucuaccccacuguggcugagcucauaccuaaagagcaagacuaagucccuuuuacuuuucccccuguuuuucucaagcaggagucuuucaccauagucaucacagcugggaauaugcaagguuucaccuaaagucaacauaucuaagaaucucaccugaggcccacaguauacuaccuggauagcguuguuaguuauccagggaucaagagcucucuagucagcaggugaugaauccugccaggacuggguccuucucaucaaggcagcugguuucuuucuggcccaggauuugucuagaaaugucaucuaggaacuagguccuggaauagggaccucacaagucugccugguacccuguacuauuguugcugagcuaguauccaagaugcaagacaaaguccucuuuacucuucacucuccucuccuuaagcagaaggaaugaguaucuuuugcagcugugagcugugcugccugggguugggggagggguggcacaagcacucccuuagcugccccagcuggugucuccuuaggucauauacugccuuaauccacugguucuaagcccagcacagcacaagggugugcuuaggaauagccauccuuguauccuagacucccuuucaaguuuaugaccccagagcaccgcagccugugguggcaacgauugcagagaaacucaaguucugaucgcugggaugggagauucccuucuggccauggcugguucaaauguucccuccaugggugggugccagcugagcccagcacagcuuugcucuccacugugacagggcagcacggaguucagugccagccccccaacccccaccccagucacugugcucucccucuucuaagugcauagauugucuuuccacacuaugugguugcugccaagggaugagggagggugacgucagcaauguguuuucuauccucucggugucucuuucagugauaggaaguuaaagccacguaacuuuaccugauuuuuggcucuuauaacacugcuuuuuguguguacuuaguuguuaaaauuugguuuuccugcacggagaacccuuggugacaucuucuauucagccuucuugcucugccuuccugacacucuguacaucaauuucagauguucaaaagucucauaauuuuuugcauauuugccuuaguaugagacauuaaaagguagaaaauucugaagauagaggacuaagcacauauauuuacuuuucuucccuccugaaauccuauugaaaugucaguaaagacauguaguaaagcaaaccugaaagaaauuugaggugccauugggauauuucuggaagauagaaaguaaagaggcucagaccaaugaauaaacuggaggcauggaaacaacacucuacaacaugcaaaagaggaaguugcuaugguaguaagagccauucccuggaguaaugccaacuucaaagacaaaaauaacagaaugaaguaggcuacaggguagucaucaaggagggaaggcucugaagaaguguuuaugagcagccaaauaguuuagccccuucuucucauuaugccauagcauuugcuuccuugaaauguuuucucaacaaaguugaaaaucuaggugguuagcacauacagcuaugaguguugaacacaauaugagaagcagaacagauucuagguuacuucugggccucuaccaaggcaugggaaagaacaaagaagcagaacuaauccacagugagaaaaauaaauuauuccguuacaggaaagaggucccuauccagacuccaagagaggguucuuggaucuugcacaagaaagaauucagggugaguccauagaguaaagugaaagcaaguguauuaagaaaguagaggaauaaaagaauggcuacuccauagacagagcagacccgugggcugcuaguugcccauuuuuaugguuauuucuugaugauaugcuaaacaagggguggauuauucaugccuucccuuucuagaccauauaggguaacuucuaauguugcuguggcauuuguaaacugucauggugcugaugggaguguagcagugaggaugaccggggucacucuuguggccaucuugguuuugauggauuuuggcuggcuucuuuacuguaagcuguuuuaucccuuagcccuuaauccuaaacuuaauccuacugaaagcuauuuuaacccuuagcccuuaauccuaaguguugcagagggaggaagauccaucuuccauaacuucuucaggcugaauaggggugaugauauuccugccuaacuauuagggucuccuguguucaggguagagaggagcucagucagaaagcaucaguaggaaucaguaaggaaucucaagacuuuuaaauuuuauuuucucaagcaucagugaggaaucucaagccuuuuuuauuuuauuuuuauuuuuauuuauuuacuuauuuauugagacagagucucacucugucauccaggcuggaguacaguggcaugaucucagcucacugcaaccucugccuccugggcucaagcaauucuccugccuuagccuccugaguagcugggauuacaggcaugugccccacacucagcuaauuuuuguacuuuuaguagauaccagguuuugccauguuggccaggcuggucucaaacucccaacugcaggagauccuccugucucagccucgcaaaaugcugggauuacaggcaugagccacuacaccugaccucaagacuuuuuuaaagccaagccaagucaugggcuuguacccucaaauaccuaugaguugaguaaauuccucuccuuuuaaggucccaagauaacuuggaacuccuggcucuauuagaaagugacauucuuuacuuaccacaggacagaaacacugugugcagagacuguguagacaagguaugaggccaguucuccaaaaggcuuuuauuggcuuuacaagucaaguuugauuccuuaaaggaauggacaccauuccagucaaagccuugguaaaauaccagaaacugguuauuguguccuuuauguccuguuacaaaugaaaacagauucuuuuuuuuucuuucuuuuuuuugagagggaaucucgcuccgucacccaggcuggagugcaaugacacgaucuuggcucacugcaaccucugccucccagguucaagugauucuccugccucagucuccugaguagcugggauuacaggcacccaccaucaugcucggcuaauuuuuguauuuuuaguagagacggaguuuugccauuuugaccaggcuggucucaaacuccugaccucaggugaucccucugccucggacucccaaagugcugggacuacgggcaugagccacugugcccggccgaaaacagauucuuauugcacuuaugcaaauaacuauauugccauaaauuaagaacauucacaaauaguuuccaaauucuggagaaaucacauggagagaaacaaauaugccccaaauuuuggucacaggaguauacuuuacucaauuguuuaaagcuauaaauagcucaaaauaaaaguuuucuugauucugaaaaacaaaacaaaagaucagcaacauuuuaagccaaauguuaaaaagauuauuuuagacuucuauuaguuuagucaaugcaguuaacucguguuugauagucaugaacauuucagcucuccaugagaguccugaaaguuuuuuccuccauucugaugucacagucuccaaaguuaucagaaaaccugcauucaagaacaucugcuagaguuguauaguugaucauaaaucaccuacuaaagaggaccaaaacaagacaacaauugucuguggaugacaaaacaucuuaggacagucacaguuaaaaacauaauugacaaagaaauucagcuaucuuuguagcauacaauaauuuuauguaauaauuauuuaauaacauacacuaagucauuuuagaauuauaaguuuugcauaauuuuggaacguauaccaauaacauauuuauacaaauacagcccaaagaaaaugaaacaccauuuuacauuugauaaugcuuccuguaugacuuuauacuaaauaagcuaaaugucacuguugcauuagugcauuauuggugucaaaccgaauucuuaauaaaaccuuacagacaaauguauucaaucuuaaucaguuugaccauaagguaagauuugcauaaaucuuuuauaacccuuuacaaguuuuguuaaagagcagauuaaaagcaagucuuugcccuaaggaaaaccuguuguacuuuuauuccaauguauggaaacacugaauaauaccccuguaacuuuagccaacauguucacacacagaauuuuuuuuacaagauuaauuuuucacaaaacuuccacaacuuguuuaaaccuucagccuuauuuuaucuaacuuaaaacaauccuuuagccaaaaaguaaauaaauccacauucccaugacuuccuauaaucuuuuaccaaaagcauauucuacuuuccuuacaggccuugcguguagacuguuuuucaauagucucaauuacauguuaaguguuaacucuuagcgacuuuuacuuuugguaaaaaccuugguaaguaugggauuuuuaauuuuguacuagguguggagccugggacccagacagaagugcagauaaggucugacucuuuccagcgucuaacuccacaugucccaggccuuaccuagcuguaaaacaggcaaguuguacaguuaagagucauagugacauuuuaugaagcaguuaggaggccuaaucaccuuuaaauuguacauuucuugcauaaauucccuuucauaaauucuuucacaacuuacacagacaaucuaugacguacuuggaccuuccgacuuguccuaaacaucucucuuuuuaaacaaccaguuauuuuacuuuaggauaaaaauuuauauacaagagcauuucuuacauaaaauuucuuuucuucauaaccuucuuugcauaguuaggggucaugguugauuucacguauccccaggccuuaucuagagucuaaugcuccaaaacaaauugaauaauuuuucaaaguuaagcaguuuaugaccuuaaaguauuuagcaaacuuaauaucugacccacauaauuuagacccaauguuuacauuuuugaagauauuuuuauuuaccaauaauguuuaaaacugucuuuauuucccaaauauuacuucagucacaugaacuaaaugaaaggcauuacacuuauuacuuuucugacaaaauauuugauuucaggucuuauuauuaagccaauuaaucaagcucuuucacauauaaacaucacacacaacacauauaaauacacagacagaagauagaggacucauucccuaaggcgggaauuggacccugaaccugggccaccauugugauggcagagaccaagagaaaguacugccaugugguuacaaggucaagcucccaaggacauacaagacaagagggaaaccuuauccaguuuuuuucagggacuugcagcaaaguuuguaacuugacaguuugcugggccaucuugaaaagugggcuuacaagguguccuaagcccauguucuauccuaagguacaccuguucaugacaaaacaauacagaaagacacacaaaguauaccagcuucacuacagcuuaagacuagcuucacaaguccuuuuucccauuaaucaaaacuuuguagaagauaaacacugauuuuuaccauucauucaaccaguuugcccagagagaaaaaggaaagcauugccucaggcgggguggggaaggcgaagaguucagggagaccagagaaagaccuauccauuguucaaaaguucaaguggccacuuguuggucacaaaggggucuuuuccagcaguuccaucagcucucaaguuuuucccuuuuuggggaggaaaagcuccccauguccugugauccuguacaugccuaaugcugucacccauagccaucagcaaagagugcaaggcagauuaauccaaagagaauagcaguucacaucccguagugccaaacccauucuuagccaaaagggacuuuaccgagaggggccucuaaccccuaaaucuuauaaggaacccuaacccuccuaaguugggucucuaacccaagguuggccaagcaucccugccuuuuauuaagagggaacucuaacccagugucuuaggagagacucugacuccccuaaguugagccucuaacccaaucccauuauuuacccggguaccccaccacuuacccagaguuggcugaucagugcugugguccauuuccuuuggauugggggguuucuucaguaucaucccuuugggguuugccagaaagauguuaccaggccccaccacuugcccaaaguuagccuuuggguuggggguuuccuuauuauaguccauucuguggucaccagaaagaugcuagaggaaaggaguccugauccagaccccaacagaggguucuuggaucuugugcaagaaagaauucaggguguccauagaguaaagugaaagcaaguuuauuaagaaaguagagaaauaaaagaaugguuacuccauagacagagcagccccaugggcugcugguugcccauuuuuaugauuauuucuugaugauaugccaaacaagggguggauuauucaugccuccccuuucuaggccauauaggguaacuuccugauguugccauggcauagugggaguguagcagugaggacaacugagguuacucucauggccaucuugguuuaauggguuuuggcugacuucuuuauugcaagcuguuuuaucagcaggaucuuuaugaucuguacuuugugcugaccuccuaucucauccugugacuuagaaugccuuaaccaucugggaaugaaguccaguaggucucagccuuauuuuacccagcuccuauucaagacggaguugcucugguucacacaccucuggcaauuccacuguagcuguaauguacucuugguuggucacuugugcaaaucaucagauaugugcuugcuucuguucacaaauccuaaggagauacccacugauagauacacagcauucacucauguagcgucugaaucaacauuccugcucuggcguuauaggaccuuuuggauaaaacaaccucuuaacgguagagaaaauccuugcuagcugccaauauguaucaaccuaguccuuugucaauaaauaagaauggaucaccauggaucauuuagacauuugaggcaaaucaauagcaugaaaguggagaaucaaguuuaaccaaaugaaugguaguggcagaaaggcuagcugucuaccaaagguuagugaucuccguucauggcauacagcuuuccuggaaucaaaugcccagccaguggcagcauuucccagacaccuucgcagccagguagggucaugugacuagcucucacuagagagcucuuaaccacauuuaagcagaugucguaagagucauuucuuggccaaagcaaucaagaagcuaguuugucuuucccacuuacuucuuuccccauagcuucugcacuuauuucuucucaaaugucaccuccucagagaccuucccugauauuccuaaauaaaauagcucacacucuguccuugcuccaucacucuuaaucuagcccauugccauguuuuacuuguucuuauagcacuucucaccguaugauuuuugauuaaauauaucuguuuauguguuuguaaaaaaucugucuuccccacuagaauaaaaacuccaugagggcagggaauuuaauuuauugcagcuauaucccagccucuacagcaguguauauaaccuaucaaacauucaguauauagagagaaugaaugauuaaagcuuugaugguggggaaauacaugugccucaagaaggaguaucauaucauucaguuuuuaguuagguauccaugcugagguugucaaggggugcuagagaaacucaaggacaguuuuguaucuuucacauauaaauagacccaguggggugaagcuucaaaaagucuaaggcuacaauuuccaggugaguauauugacaaagguugagggaagguauugaauuuuugcugcacccacccuuguucacaguggucugugggcucugucacuuccaguacaguucuucgcuauagugagaagcugcaggaugcuuaaguagucucugagggcugcuguuuuguucagcuuucuuuuuuuuuuuuuuuuuuuugagacagagucuugcucugucgcccaggcugcagugcaguggcgcaaucgcggcucacugcaagcuccaucuggguucacaccauucuucugccucagccucccaaguagcugggacuacaggcgcccaccaucacgccugacuaguuuuuuguacauuuaguagagaccggguuucaucauguuagccaggauggucucaaucuccugaccucgugauccacccgccucggccucccaaagugcugggaauacaggcgugagccaccgcgcccggcccucagcuuucaaacaauacagaagugcgaaaauuaggucacaccucaugaaauuuaaauaaugaaacauucuaccuagcuuuauaauacccuaguucuccaacugcuauauuucauugugccuguaaauaggaauuacuauuuuugguuuaguaucacaacuugaggugaauuucugcccaccccuaucccuggccauugugggggaacugacauguuuuauuauuuauucuugcuccucagaauggauugggaugaugaauauucucauaauucuuuugaccuacauuguuuguuaaacucauuuccuggagacuuggaguuugagcagaucuucagugacauugaugaaaagauugaacaaaaugcugcaagguaaauauuguuaauuauuuaaaacaaguuguuuucacauuucacuuauaugaaauuuaccuggucuauuuguauccugcucuuagauaauuuuagguuuuaauuaucauuaacuuucccccaaaauauugauuagaccccccucucacuuaaaguuuacaugauugucuuuaucugaguaguauuuuuaagacuagaaaauagaagcacuaucuugaaauaggcaauuaaaguuuauugaauuggcacuaauguuuucuuagagcuugucaauguugauguccuggauuuucauuaauaugguuagaguguaaggcccugauugcuugaguuacuaaaaacagaacauuaaaauaaauuauuuuugcauaauauuggucauuuuaugauucuuucucacuuaaguaggaggcuagagacuuuauagagaguuguuaugcuagauuagucaucaccuaucccaaaaagucguguuaccaaauacugggggaaacagugacagcucaaugguuucucauuaauacguguucuuugguagaaaggacucuguuuucauauguaguuguggacccuauaaucaggcaguuacuuauuugcauccuuuugaucaaagguucuaauuuaccucauguagguuacaaaugugcaaaccacaguaaaaauuucuauuguguaaugauacauagcauuucuuuuuuuaaaauuuaagauauaguuaccuugaauuuccaaagaaacugaaccaaguaagugaaaugguccuaugauauuuuuccuucugcuuuacgugagaauaguuaguucuuuauuauaacaaugggcauaaguaaauucaaaagauagcauauuguuggagaauuauacuuaaaaacaaaaucuucucccaucccagaaauccucuccaugaagguaguagagaaaggaaaaagaaacacuuuuauuauugaauaagcauuaaaaaccaaaauaugaugugcauuucaggcaguucacuaagagcuugcaaaaauggaagggaaucccaccccuuuaaauagcaaagcagauacagcccauuacauuacauguuauuaagauaaacaaucacuaguccucagguaggaagacuggauagcauauuuugucacacauaguucauccuaacuuuuuacaaugguaauuggggaaaccaccuguguuagcuaauuggcuuuauccugaggagaaagaaacuuuuuuguaucuuuaugacaggagauaguuuugcaaauugcaacaggcaaccacugaaguuaggcucuuacucucccacaggaacugggagauuggggagcuaucucccuugaugcuugcauuucaagaagauagcucccagguucuugagaaagacauucuugggucacaaagcugacaaaaggacugcugacaaacggcauaucuagucuuccgaggaauagauacauggcaaaagaugaaaaaguacuuaugauuacaagcuuuuuuuuuuuuuuuuuuuuuuuuuugagucacccaggcuggaguacaauggcacgauuucggcucacugcaaccuccgccugccugguucaagcgauucuugugccuuagccucucaagaagcugggauuacaggugcccgccgccacacgcagcuaauuuuuguauuuuugguacagacaggguuucacgacauuggccaggcuagucucgaacuccugaccucaggugauccacccgccucagccucccaaagugcugggauuauaggcgugagccaccaugcuuggccuaugauuacaagcuuucuaagguaaaugcucuaaggaaaaaggagaggagggaaaucuuuucccuuauuuucaacagggaaaauuaaacuucuuauuuuuaauuuguauuugcccuuuauacuauaccuauauauauacacauuauauauguauuuuagagauagacuuaaccaaacugagaguguauaauugauauuucauauaaauauaaaauaacuauaggguaauuauguauuuauaucuuucauguuauauauuuauguauuuuaugacgcaguuucuaacacaaaggaacuuacaaaugaaaauaguguuacuuaaauagauuaacaagacauuuaccuaaauuucagagaugguuauaguuuuaaaaauugaaauauuuuuaaaaagguaaaccauuuccuucacaauggcauuuaggcuccaucagaauaaaacaagucacugaacucugaugcuuuuguucuggauugcuuauuuuuauuuaugaaccauucauacuuaauuuuuugccuaaccuagucaaaaauaaaucauauuuaaaaguaaaacagugauuaaaacauuguauuuugcauuaaaaaauaguuauuaggucaaaacucagauguuaguguuaaaaagaaaauacaauauggaacauaggauauaauuuuuaaauuaaaaauauuuuauugcccauauauuaaaacgaaccuagagcagaacgucuucaagugaccauugaucuucacaagggaccaaauaaggaaguagcucuaugugcuguauacuacauuuagaaucaagucuauuuuucaucaaauucaauuauguuuuuauuauacuccagagaauaaacauaauaguauaggguauauauauuuuuuaaaauaaaauacugaauaauaacugugguucagaagaguauaaaucauuuaugcacucauuuauugccuucuaacagaauagcuuuuagaaaauuguaugucaugacgaaucaguuaugccacacuuacacugcaguaguugaauuacccuuggcauuuuuguauucuaacaguucuauuuaucucccaguaguguacauugaauaaguaaugaacaucuguaugguauagguuuuccuccauaguuuuaaaagaaaaaaacaacauuaguaauucauuuuaaaauaugauauuuuuuccuuauacuugaauuuuuaaaguagcagugacccugacaucuauuuaugaauuccuucucucuucuuaauaucaucagguuuuaugagccacagggucuauugccuccccaaagcagugauucacccgaauggaccagugugcccaaaggucacugaaccuucaccugcccuucaagaaaggcugucauucucagaccacuucacuuuuacauucucguuuccauucaagucagaccugggugacuaguaggucugacagcagaaauuagugaugaugaaucauuuauucaaacacauaucaaaauagguaacaagagguaaauaacaugccaaagagaaacauuaugaauguuguaccuccguaucauuaguucccuaacugaaaacugcauauagcacuaaugaacugagugguacuuauuaguuuaacaagauacugagguacagaaguucuucugggcucacaauaugacacagcauaggcuggaugugguggcucaugccuguaaucccagcacuuuuggaggcugaggcgggcggaucacaaagucaggaguucgagaccagccuggccaauaugaugaaacccugucucuacuaagaauacaaaaaucagccgggcgugguggugcacaccuguaaucccagcuacucaggaggcugaggcaggagaaucgcuugaacccaggaggcagugguugcagugagccgagaucacaccacugcacuccagccucggcaacagagcaagauucagucucaaaaaaaaaaaaaaaaaggccgggcacaguggcucaugccuguaaucccagcacuuugggaggccgaggcgggcggaucacgaggugaggagauggagaccauccuggcuaacacggugaaacccugccucuacuaaaaauacaaaaaauuagccgggcgugguggcgggcgccuguagucccagcuacucaggaggcugaggcaggagaauggcgugaacccgggaggcagagcuugcagugagccgagauagugucacugcacuccagccugggcgacagagcgagacuccgucucaaaaaaaaaaaaaaaagacacagaaugauuuuucccccuuaauguucaguuggauaaauauaauuguaucuuaaaaauuuucauuuucuaauuauagacaacuucuguguguagcuuaggaaguaaguuuugcugguaccaaugcagcuggacuacuuuuuuuuuuuuuuuaaucuaaagaaagauguaaucucaauacuuggggaggccaaggcaggaagaucacuugagggcaggaguuuaaaacuagccugggcaacauagcaauaccccaucucuacugaaaaaaaaaaaaaaaaauuagcccaggcuugguugguugcucaccugugguccuagcuacuugggaggcugaggugggaggauugcuugagcccaggaauuugaggcugcacacgcuauuguacuccagcuuaggcaacagggcugucuggaaaggaagggaggaaaggaaagggaaagggaaaugaggaaaggaaagaaaaggaaagagggagggaggaaauggaggaagggaggaaggaaggagcaagaagugcuaccaggucgggugggggcucaugccuauaaucgcagcacuuugagaggcugcguguggugugcagaucuuuugagcucaggaauuugagaccagccugggcaacauggcgaaacacugucucuacaaaaaacaaaaacaaaaauuagcuggugugguggcucaccccuguggguuuagcuacuuggggugcugagguggaaggaucgcuugagccugggagguggagacugcagugagcucucguugcaccacugcgcuaccgccugggcaacaaugugagacccugucucaaaaauaagaauugcuaccagcaauaauacuguuugacuucaccuagaaaaugcagggagaggggagacauuuaaccaugccuauuaaugagaugguacauauuccauagauuacacuuauuuuuuauauaaugcuuaaauuuuuugagcuuccauauuaaaaauuugcuuucaaguuuuccguaugauggcuguuuauauguauguagauacacacacacucacacacacacacaaauauuaauauauuuuauagccagagcaaauucuacaaaaugaaaauuagucauuucaaagguuuuacugugcauuauuauuucuggcaguauuguggcacuuauuuaauaauaagaagaugcaaauuaauguuugcaaucguuuuuguaacuucuuguguuugcacuucaguuuuggguuucuucauuauauacuacaucucaaagaaucccuaccucuucuccccuccuacugagcaaaccaggccacauaggaagaaaccugaaaugggcuaauucccccaacugcuguugaacucagaguaaaaccuuaacccacuuuccaacucugacugggccuuuccagcacccuuguucucuccagaauuaagaaugcauccugggcagacagcauccugggcuucagcagcgcaguagccuaaacuuuuucuggccccauucauauuuccuacuuuuuaaacuuuuccaauucucccacugaagcucucagcaugaaguccagugaugcuugcagguagagguggugguaagugggaaaaagacucucucaugguggccuguugaaccauuuuuucaucaucauuuucugucauuauuaguucuauuauuuugauugucuauggugauacuuacuccuuucuccgucaucauacauaguguguccucaguguuuccuguagaccucugcuuuaggaggcugagaugaauaggguaaaauguggagucaguagcucuguuggauaauuguuacaagacucuuucaaguguuguggacauuucaaguguuugaguuuuuuuuaaguacaguauagcuuuuauuuuuaaauguguuagcuucaccuacucuuggccaaauaagcauaagacaauagagaauuguuguuuggggauauuccuaaaugauauuauuguauuaucuuuccauggcaaauaaggaaagggaagcacgugucucccuguuuauaaauuguuauaacaaaaguugaauaguaugauacugaaaauccagacuucauaaagagaucgagccaauaguaguuggacuacuauuucccagagaggaucuuaguuaaugggccagugggaaguaagccccgacccuugauguaacaaucugaggugccuggugaagaccuggcccagcucugaaagcagaaacaggggagggaacacuauaagaggacuggagccaugguaacagauaugacugcuguggccggcucaucuuucauguuggguggugccuggagauugaauccaagccugucaacuuugccaggaaaagacccuugucauggccucagcugagucaacaccuugucuaaaaauggucacuaacaccacagccauugcuaaucacaauccaaauucuagaaugccauaauuaggaauauccuuucaugggaccuggaauaggagcugggaugggaaggggcuggaagcuguugccuuuauuuucuacuuuaaggacuuuucuuuaagccaggcaugguggcacaugccuguaguccuagcuacuugggaggcugaggccagaggauugcuugagcccaagaguucaaauccagccuggacaacauagugaaacucugucucauucauaaagaaauaaaugggaauuuaaaaguaauuccuuuuuuuuuuuuuuuuuuuuuuuugugacggaguuuuacucucguugcccaggcuggagugcaauggugcaaucucagcucacugcaaccucugccuccccaguuaaagcgauucuucugccccagccucccaaguagcugggauuacagguaugugccagcacaccuggcuaauuuuguaguuuuuuaguagagacggguuucaccauguuggucaggcuggucucgaaccccugaccucaggugauucacccaccuuggcuucccaaacugcugggauuacaggugugagccaccaugcccagcuaguaaguccauuuuuuaaaaaaggcuuuugauuuccacuuugaggaaaucaaaauauuacuuguucuucacuguauuuucacugccuaaaacaguccuggcacauaguaggcuagaagauagucaauaauuguguguuagacaugauucuuagguauuuauugcauuuguuuuaucuuaaacuaguguaaaguuagaugaauagaacaugauagaugaagcuaucuucaaaugcauuuuuccuuuucuuaaauauuuuugcauuauaaaaguaacacauacucaggauaaaauuucaaauaguagagagagcagugaagaggaaaacuuucuccauuccucugacuuuccuagucuuguucuuuagaggaaagcuaucuugauaaauaauuguguaauuuucuagaaauauucucuacauaaacauguauguauguaccccaaaauagauuuuuauacaaaugggaauuauauguacauucuguggucagauuuuuuuacuuaguguaucuauauacacacaauauauauauacacuacauauauacauauaugauauauacauaugauauauacauauaugagauauacauaugauauauacauauaugagauauauacauauaugauauauacauauaugauauauacauauauaugauauauacauauauaugauauauacauauauaugauauauacauauauaugauacauacauauauaugauauauacauauauauguauauauacauauauaugauacauacauauauaugauauauauacuacuucauauauauaauauauaugagaguauuugcuguaugccuaccuccucacacauaaaccauagguauuauuaaaacccucaguauguagcuucucgucaaaucuguugucuggcuuaaugauugauuuaaucaggacaauuggagauaaagauguagaccuaaucuguuuccauaucucuuaggauucccauuauuacguacauucucccacucucuuuuuuuuaacugucucuuucuccaaaaagagaaucaaaggaguuggcacagggcaaaugcugguguagauccuccacuuuucucuuccuaauuucaguuuguaugguuuuguugggauaaaccacauucugacuucauuaaauugugcugaaauuccugggcaagccuuuauagauuuaaaaaaaaaaaaggagcacauuuacuuauucuugauuguaauggguauuaaacuauguccuucuagcccuauagaauguuucuagaaacuucucuuuauauuauuaacauagcccugugccacuuccaucuugcuucugucacuaguuuaugagaagugauccaaauuagauguagauuuaggaggcagaagaagugaucuguguugggaagcucguucuuaucaauacaagaucacuuugguccugccaguacuacccggcacccacuggaauucuggggaguauuucacaguugguugacucuuuugaaagcacuuuagauuuucuuagguugauacaggccuacacuaggugugaauggccagaguaaagcaucuggaccauugaagagccauucucaacuuuuguagugggauccgugguauauaacaacaaaucaagagaggacccuaacucuaaaguuucuuucauacuguguugcucauaguaaacucugaacaaaagguggguuaacaauagaugggaauccugaaagaggcuauuaauauauagucccgaugaccaaugauaagggccuaugccaaaacuuuuacaaaaguaauggaaaggaaaggauacguaugagaaagauuuggugucaaggguguuuuuuccugaaaguguaauuacaacuuuuugaaaugauuaaaugucuccgaaauagaaaacaauucaggacaaguuuuaauuucucaccauuuuagccauugaaguaguuguguuaggaguauucuuuuuaacuuuuuaacuauucuuuuuuuuacuuuuuuuaacuauucuuuuuuaaauauucuuuuaaaaaauauuauccagaaaugucuuuguuucaggaaaauaaguuuucauuucauggcugacuuauauuuuaauuacauacuaguuuguauacaucagcccucuucccuauuaauuaccugauaauuccaaggaauuuuaguaaucuaguuagauaaauaaggcuuaucuaaaaacuagaaaaucuauuaccucacaaugauuucuuuguccuuucgaacacaaaaagcacggaaaugaacagaaauguaacagaaucgaaauuucaguguaacaauugaaaagacuugucuuuuccuuaaguugaacuuauuuuguggguaaagaaguauaagcaagagcaucaaaauguaaaaguuuuaaaauuuuuuuuuaaauuuuggguuuuccauacuguaauaaauaagucuuuaagcucugcuaugaggcaucuauccugauuuaagaaauaaaaauuuuuuguauucuaacauuccaugaaagcacauauauguguuuucuacaaucuuuuuauuuaaaaaguucucauaauuuaccaauggaacauacuuuuuuccuuuuaacuauuuuaugacuggauaauacuuuugaaaucuuauaagaacuuuauaauaagcugaaguuucaagaguuuauaauuauccucuucuguuuuucaguuucuuauccuaucuccaacuguaccaguucaauauuaaucagcucccggacugcuauuguuauuuaaugcagucuguccaauaguaggacaucucagccuuuuuggaaguaagcuggugcauauauacauacacacauacauccauacaugcaugaguguaguagugaccauaaaaauaaauucauauuucuuauucuucaaauaaauauaguuuuaaagugaggcaacagugagguuagaugacaaguacugaauucugaggggugaggugucagggaauuuuaaguaccgugauucuacuaauguucuuaaagcaacauccuugcauauaaucuccucuucuacaaggaaaaaccuuuuuacaccucccacaggcacuuuuaguggcucccuccuguguacucccuuagcacauuguacacacuccuuaucaagucuuacuguguuguaguuguuuauuuacagguuuaucucuuucacuagacagaauuccuuuagggacaggaugacgucuuauucacauuggguucccuaguauauaucacaaugccuaccacauauuuaacauucagcuaauguuuaucaaauauaaugccuucauucaauaagcaauuuuuacagucagggaaucuaggagugaauguugaaugagaaaauuaccauagauaucuuuuuuuuaaaagcauacuccauauugcauuuuaaaaaugcuuuauaaauugauuuauacacagccucucaguaaugcauccacuugcauacaucauuaacugggcuaauucagagucauuauaauuaaggcacauugggguucaaauuuauuaagaaauguugagacauaugaaaaggcauagaguacuaugagaaauacuccugugcccaccaucuaguuuaagaaauaaaacauuacuuguauagcuaaagcucucuguguaccucuccccaauuucaucccacuuccauccccacugugccagagggugcugcugaucauuccagugcauuuccuuacacuuuuacuaccuauguuuauaauccugaauaauguguagcaucugaaagauaacauuugaaaauguuaccuuuuaaauggugaaaauuaaguuguaauuuauuuugauuaaagaagauaaauugucagauuacauaccaaacugacauuuaucauaaauuuugaaaauauuuauuuuguauaacaauuggacaagaaauaucuagacuucagaugauuaaguuuuuagaacaagguguauaggcauuggugaguggcagacaacaagacagccaacuaaaaacaaaaucagguguagauaauuaguucugacauuuuauaauuugugacaaaaugauuuuaaaauaaaguuuaucugucuuaguuuguaucaaugagggagauccccugaaaugcaaccacucaaucccuuugucaguauuuggacaaauuaccaaaauaucuagcccucuaaaggcuuuacccuauuuauaaauuguaguuuuuggccucugcccagauucggauguuagaaauuagccuaaaaucugaguccucauugaaacagauuuagguagacuaacugcugagccuuuccaauucacauugcuguaaucuauuagguuucauugaaugagacacaugaggaugcuauaauaaaaaccuuugauaaagagucccuagagucaagggguaugcuuagggcauuguguuucucuguccauagaagugcuuacauaaguuaagaaaauacaagccaaucucuugucagacguagaagugguauuccugaauauggcugucccaucaggaaauugaguggccuguggccagaggagguauuguuuuccuuuuaaguucuuuguguucaugaaaaggcucuuugauucucagaauguauuuguuucaagguaauuuacuuugaauucacucaugcucagaagucuccugaaaacuuuuacuuaaacuuuuacaguguauguuuuauaggcaacccacaccuggaugaauuucaaagagucuuucguaugacaucuauuuuaauaaugagcgcuugguuucuaaagccuaccagguucuaucauauggaaccuuuaauuaauagcaguuacguuuucaaaacacuaacuuuaccucuuaguaucaaaucuuucuuaauaugauuaagagacaaaugcauagcugucaauuuuuggugagguguuucagcuucaaaggaauuugccuguuugaaagcuuucuugaaguuuagauaugcugccaucaggugguaguaauaugucauaucccuguggcucugcagauggcacucugcuaaaggucaccaguuuaccccacaaagauuuauaaucaucaaugcacauaaguguguauggaaauuaaaauaacauaguguaucuguuauuuuaucaacaggaaggauacuuugaauggaaauuuuaaaacagauacauauggcaagauucuacuggacauuuuuucacuguucuugguuuacuuuuuuggugaaugaagcauuuuauuuuaugccuuauaaauauuuagaaaauauggaaaaguaaaauuuaaaacuuaccuaauuacacccacccaaauauaauugcuauuaacccuuugcuucauuuccuuccagucguuuuuuaaaugcaauuuuuaguaauuuuuguuucuguuuuuuguaguggaguuggauggcaggaaaagguauuuggcuguaguaacauuguguauauagcuuguauacuuuacaacuuuuaaaauuauaagcuuuuuauaacuacuucaugacuucuuacuauuccguugauugaaauuuuucauaauuuauauaguccuucaccucuuaguagauaauguauauuucuaauauuuacaguguucaguauuuuaucucucccuuucauccacugccuaucaagagggcuauuaucgaauugcaucuaugcuugauuuuuguuucaacacaaaagaauuucuaguucaucugaguagcuauuuuauauuuccucuaucacauuuuuuacugccagaaaauuugaacucucagcuuucaacuaugaauguauagucuguuauuauuuucauaucauaugaaugaauuuguaaauuguacaaagccagguaccacauaugaagauuucagggccugugauauuaugaaaugaagccauuaucuauauccugccaaaauaacuuuuucuucuguuuuuuauagcauaaaacauugcauuaaagagauacaguccgaaauuaacaaacaauguccaggugugcagcugcaaacaacaacugacugcuuugaauggcuaacuaacuauaauuacaguacaucugaaucaucuuucauuucucauggagacuugauaaaauuuuucaaaacacugguaaaaugaauuuuuauuuuaucauggagugggaugaguaaacagggaauacaacucauucaauuucuauacguaaauauuuauuugagugaccauauuagccugccauacauagggguuuguguuuuuauguuccuauauccccaacauaauccacugagcuauuuguuuuaauuuuuaacuaugauuuuuaucaauaaaauaaaauuuuauauaaauggagauacaauauuaugauuccugggugauuugugguaugauauauaucauaucaauaccacaaaauguauugauguguaucacagcugucuaccagaaaaguucauauucauuauguuuuguauccuuucacuauucauuuuuuauaugcucauuauuaaagcauaauaagauccccauguauugugucuauuaaguggccuugacuauuauucccugcauuccuaaccugcagucuaacccaguucuuuucaaucaagguagcaauuuaugcaagaccaccaaaugacagagaauuauuauguuggguauucuuaauauugaccaccaucuaugcuagagaaguuuuuguaaacuucaauaagaacagugauuuuaucacacuuguuucuccaaggcuagcuagcuugcaaaaacagauucccagagaagcagcauaauuguuagaaagcaguacuucuguagcuaugguuuuaauuuaauuuagggaaaaaaaggcacuguuuuugucuaaacaucaaacauugacuaagacagauguggaaaauaucuggagguuguagauggcuuaggaugacagaaucagaugaaaauaguuuuugccuguuguuauuauuucagaugucucuuuaauuuuacaaaguaauaaaaggaagagaaaggaagacugugugcccugaagccuuauucuuuuaaggaaaccucucacccauuaucuccugaagguggauccuuaaagaauaaauauggauauaguuauuccuuuaauuucuauuaagaggcauguguauugaauuucauuaaugcugauguaauaaugcuuucucauuuaauuaaaagcaaacgcuuuuaauuaucuuuuaaucugucacacauaagucauucucuauucacugcagggcaaaggccgccuuaguuuugcucaaauucauuagacugauaggcuugucccaguccuagguuuuuuuacauaauugaucauguuauuuuaaggaaggaaccacauuauuaaaacagauccagauuuaaaugaccuuauuaucaaguuucuacaugcuaaaaaaugucaguccugauggcauuuuucauacaucuguuuuuuucauagaaaauuucuuguuaauuuucuagugauuuaaauaagaaacagagguccucauuauggcagauguacugaaguuauuuucaaaauuuaagcaaucauacuaaacauauguucuaaaccucuguaaucuauuauucuuuguuugaucaaauauuuacaguuauuuacggacuuaaaaaaaccaaggcagaggcaccaguaugacucauuugcuuuauagaauuuacaguaaugcugauguguccuaucuaaggacaauuucuuuuccagaaauaucaaaauaacucaauagcaguagaggagagagaaagaagcuacacagaggucauguguacuuuguggcucucuggaguguagcagaaagaauguggaugaagagaaagaagccagggaucauuucuugguucugugccuuacuguaugugacuuuugaaaagucacugaagcaugccugauuuuagaguccuuguguguaaauuggguuuuuaaauacauaugccaaagaguuaucauuaugaauaaaccaggaaauguuuguauaaauacuuaaaaagcauuucuugguauaauuauuggguauaauuauuuauuacagauagaacauuaggcauugcagugcuuacagugaaugagagaaaauuccuggaauuugucuaggaauuguucauaauugugaaucacacauaaugccuuugguaucuucaucaauaagaaauuguaaagccagccugauuuuaugccacuuggaccuugcuuucauuucucuuguaaucagcuuguuucuaccuagagaauauaaacuaauuucaguauuagcuaaaauagacauaauuaggaaagucagcauggaagcagaaugugugugucuaauucaaagcccaagaaaaaaguaaauuuuuugucccuuucuauucauaauuauacccaccauuguuuucugcuagcacagaaaguauaaaggaauaauuucauaucaucuuuuggggaauaauucugaggguaucuuuuucucauuuuggguuauuucuuuggagagaauugaaauauucucagauuaauuuucaaaguaaaaucuuucuuaacacaguucucaaaaaggaauuuaaaugaaaguuaaaaucuuuaaauguauuaaaauuuacuucucagaaagguauauuuuaguaacccccaggcacauacuauauuuaaagaucuauauucuagaaugauuuuaaaguauuguaugauauguucauuugggguuuuauaauaauaaguguacucauucaagcaugaaaauugucuaccaggaauuaggggcaugaucuugaaucuauuuuguauuaggaauacauuucaaucaauauuuuacuauagauuuguauuuagaauuuuuaagccagaguuuuuauacagcucaggguauauuggguagauaacaaugagggcuaaaaacuguaugucuagaaaucuaauugaaaagauaaucagcuagguuugaaaugaacaauucaaaguuuaguagaccauaaaagcuaacauucuaaaacaucugaauugauuaaauuucaaaugcaaaaaaauaaaaucuuaaggaauuuuagaguauugauuucaaccugaaauuauuaugaaauuguauaugacuauagaaaucauuuuuucuauugcacuuaaucacauuucuaauguuauaauuucauuagcaagauuuguugaagaaugaacaaaaucaagaagaaaugacauuggauuuacuuugggaccucuccugccacagcagcguuucauucccaucaacccuaaguggaacaucuuuccauuuccucucuaggacgucucuucauucuguugaagauaauuccucuauggaugucaagucuaugugggaugauauaagacugcaucuucgacgcuucuuagugagcaaauuacaaagccauaaugaaauaaacaauucacagcaaaaaauuuuauugaaaaagcagugcuuacaacaacucuuguuucuuuauccagaaucagaaguuauaaucaaauaccaaaacauacagaauaaacuguuggcuaaucuucuguggaacugcuuuccuucuuacaacagagauucaaauuuagauguaauagcucauggauaucaaaguacaaugcuuaaguuauacucaguaauaaaagaggauuuuaacacacuaugugaaauuuuagcuccaucuucaauggugaaauucauuaaagaaacuuaccuggauacuguuacagaagaaauggcaaaauuucuugaaaauuuuugugagcugcaguucagagaaaaugcuguucgugugguuaaaacaagcaagagcuccagcaagcauagaggagcagugcaugcuuuggguuagugacauuuaaaauuuuuguuugguuuaacuuaagucuuuuaauauguuuaauuuucuaagauguuuucuauuugguuaaaucucacugcaaacaugaaaauuagaaaaugaauguaaugaaauuuugcaguauacauuucucaugcauuuuuuucuauaauuguaguuauaaaaguauuuucuuucuuauuaaauuguuaaagauauuggaaauauaagccaaaaauacuuuaaauaagaguuuaauuucucuugauugcauaugacaaacaguauuugugaaacuguguguauacacacauauauauaaaugaguauauaugcuuauacacauauaagcuccuuuaucuguuuauuaaauauacgcauauauauaagcacauauacucaguuauauauauguacauuuaguuauauacauaacagaaaaguaugauuuuuaauccauuguaucuuccaaagcuaaagcauuauuagguaaaaagaauuuuugaaaauuuguugaaauuugcaguaaaauuggauauuuaaaaguuguaauauuuuagucagucaauucuaauaaugagcaacuaugaaauacuauaauuauaaaauucuguauuguaguugauuaggaagguauaacauuuuacuauagcuauuuuuaaaguuucucuacuauuuuuucuauaaggauguauacaaauaaaagaugauuugaaaauuucuauuuuauucauaagauaaaggaaaaaaggaaagaaguuauugugauauaauaaacuuuucuuauugugguuguacuuuccuaccaguggagaaaaaucaggguaaaaauaggauuauuucuaaaauuaucauuaguuaugcuuuuauauaaaaucugagguguauuucugaauaaguucauaaacuauauggcuuaaguauuugaaaauuauuauuuggugaauuauggaucuuugaauuuaugaucaucuuuuuaaaauuccuauagcucacuauacuugugcguaucuucauuaauaaaauuucaguugaccaaauuaaugugauauaugaauuuucaaauuguuuaauauuuugucuuaaaauuuuaauuuuccuccagaagcuauaucucauugcagaagagagaugcaucugccaaauucgguuauggcaaaauacaaagucaguuaauuuaggaacauuauuauuuugcucaaagcaaauagacuuuuauuuuaauuguuaacacauaaauuuuaaaaugcacuuuauuaguguacuuauuuucuaaaauuuuuauauucucugaaaaaaaaauccugcuuacuuguaaagucuuuucaauacgaaaguuuuauaugugcuaaauauaguuuauaacagaagaaaagauccauaugguugaaaauguguguaaguugcuauggagucuuuaggguugauauugaaguguuuucucauucaugagagaaaaguauguguguccucuuuaacaccagaauuugaagcauuuuccacaaguguaggugcauagauuauuucccaagcuccuuuaucugaacuuugauaugaaacaauuauuaagugagcacuguccauaugccaaacacugcgcuaaugacaacccauuccuauuaucccaauuucaugaacacagaaagaaacuuagaaagauuaacuugcccugaucauguuguaugaaaucaggauugauacuuagaagucauaugcagaucuuucuauuucugggacccauguucucaagcaccaugcuauugggccuugucuuacaaguguagaauuaaaugaucugucaccuauaaaagaaauuucaaacagcacuguucaagugggcugucugcagauaaauucaguucagcuuuauugaccaccuaccauaagaaaggcauuuagcagcuaccauguucugugcuagacacaguaaggggaagaaaacuaaaugagucacuacugcuacugccauaugagaacugcuaaacuaacucaacagauaagcuauguuguucacuaauauuugacccaaugauaauguuuuguuuauuaaggaaauacaucuuugagaugaccgacaauggcucgaauggguuguauuauauuaucuuuaaucuaugucuguaucuuuaugcucacgaaaucuuugcuauuuuaccugaaauuauagaaaggacaauccuuaaguaacaacaacauuuauuggcucagacauugaugugcauuaucucuuuuaauccuucuaaccuaccaaacaagguagauaccauuauuuauuaucuccauuuuacagugaggaaacuaagacauagagauguuaaguaauuugcucuaggacauagagugaagccaggauucaaacuuaucugucugacucagagcccuuccuguauuacuauaaucuacugacugaaaaauaggauauuuuuaaauuuaaaaacauuucucugaauccucuguauacuucuucaacuuuaguggucauuguuuucuucuucuccaaacuauuuaaauaauuuaaaauaaauuuaauuuauuuaaauuuaaauaauuuaaaauaaauuuaauuuauuuaaauuuaaauaauccuaauuuaaauguauaugauuuaaaugauuauaauuucuauuuagugacuuuaagcaggcuuuguauguauacuguagucuuaaugagcuaaugucuuaccuuuccaugcuuauaccuuaaugagcuaaggcaguuuggaccuauucaaucuuuaguugcuucugauuuuguacuuagguugaggauugguuguucuucccugaaugaccuguaaauuuuccaucauucaucuaucaucuaucugucuaucuaucuaucuaucugucuaaugugauuacuuauuaauauguauaagacuuuacaaggcuuuacauauguggguucacuuaaccuucucaacagccuuuuauauuauuuauacuuuauauaugagaauacugagauucagagagguaaauauuuuccaaguccacacagauaguaagccaaaaaaagaagauuucucuguuugcaauuauuugguauauuagcuugauaugccacuaaacucugugucaaaagcugugcaaaacaguaugauaguuagcauuaaaaauaauuuaccacuuucacuuuuuuuguuuuuuugaguuggaguuuugcucuuguugcccaggcuagagugcaauggugcaaucucggcucacugcaaccuccgccuccuggguucaagcgauucuccugccucaggccuccuaaguagcugggauuacaggcaugcacuaccaugcccgguuaauuuuguauuuuuaguagagaugguguuucgccauuuuggucaggcuggucuccaacuccugaccucaggugauccacccgccuuggccucccaaagugcugggguuacaggugugagccaccgugccuggccacguuuucuuuucuuuuuuuuuuuuuuuugagacggagucucguucugucgcccaggcgggagugcuguggcgcgaucuccgcucacugcaagcuccacuuccggguucacgccauucuccugccucagccucccgaguagcugggacuacaggcgcccgccacugcgcccggcuaauuuuuuguauuuuuaguagagacgggguuucaccguggucucgaucuccugaccucgugauccgcccgccucggccucccaaagugcugggauuacaggcgugagccaccgcgcccggcccacguuuucuuuuuuaaugguuacauuauuucugucuucuacacugauucaguguuuugcuuuucuuuuuuauugauaaugauucagaacucaguuaugauuugcuaguguuauuaacucagacacucacuagggguaguuuuuaugaugcuuuucuaugcuauguuaugcuaugcuaugcugugcuauuugugcuaugcugugcuauguuauucuaccaguuggccuuuuggaugauuguauucaccugggcaccccacagugcauucugucugccacuaauucagguuuuccaguacauauauuuaaaauauggugacaaucucucuagccauuuuucuaugauaagguaccagacagacaauuuuauuuacauauaagcuugugauuagacuuaauccacaucuugguauuguaugguaacuuuuuuucuacuuuauauucaguuuugaauguuuuguuucuuagagagcaugugcugcuuuaguauuacaauacauuuagaaguguaaugcuuguauguuuuguuaucugaaaaaaaugaugaaauaauguuaacauaaauauuacagaaucuuuuugauuuaacaaucuuuuauagaagagaacaauauuauucuuacagauacucuuacaaaguuuucagagugauuuacaaagcaacgcuuucugaauaaccgauuuuguucaucuguauucuuauaguuucucuaauuuuuuuuuuuuuuuugagacagagucucccucuguugcccaggcuggagugcaauggcgcaaucucggcucacugcaaccuccaccuccuggguucaagcgauucucuugccucagucucccaaguagcugggaucacaggcgccugccaccacgcccagcuacuuuuuguauuuuuaguagagacgggauuucaccauucuggccaagcuggucucaaacuccuuaccucaggugauccacccgccuuggccucccaaagugcugggauuacaagagugagccaccacaccuggcuaguuucucuaauauuaggaaaauuauuauuucguaaagguuuaugcuacaauauuuuuuucauuuagcuuauaaggcuuuaaagucaaaauagcuuucaaaaagcuagaaauuuacaauuagcauuuugauuauaaccuaauuuggaauuaucuggaaagucagauccauauauacaauuguacacauaucaucuacguuucaggagcaccagugccauucuuauauuguaacauuuuacuauauuuauauuuggacuaguuaugugaucaaauuaauuuuacuuuuaaaauuguauuuccuuuggauuuaaguaaaugcuacauuucucaguguucaaaaaagaaaggauuauuuacauauaauaaauuuugguuaaauaaauccucuguauuuuaauaugaaaagauagaaauaggagauuuaaauucuaggacaaacuccauggcccccauauauccuaucuuuaauuuuucuugagguuauuguuagcuugaaaaaggaagacuuaggagaauaugauaaacaccuuugaauauuugaaagauuccuaaaaucugcaguggaugaaagguugaccugaaucaccucuaagacaccuuuuuuuucauagucccuuguucuuuuguuuaaggaagacuggggaugagggaagugaaucccucaaggaaugaaaagaucauucaagauaaccaaggcccucaaaccaaagagaagauagacuucuugacuagggagacacaagaucacuauuagaaaguaggccaaucaaaagccacucaguucucucuucuacucaaguaguuuugaccauuugaaugaugauauuacgaaagaagaaaaaguauacugaagccaacucuggaaaguuggauauugucccuauuuuauagauacagaaucugugguuuggacaaguuaaguagcucucccaaaguccuggugacuacagugacuuacugugucuugcugaaugaaaucauuuguaagaucaagaauccuucaauaauuugaagaguaauucucauuuuuuuagaucccaauuuuucuguuggacucauagcauacauuuauuuuccuacguauaaaauuaaccuugaauuucgaaacuguaauagaguacaaauccacaucacuucuuucuauuuggaaagauuugcaaagaaaaaaaauccaagacuuugcauacuaauacaugaauagaaaaaauauuaccauuaauuuuaauauuuuaaaaaguaucuaaaugaagaaugucauuuuauuccuaaagaugcaaguaaccugguuacauauaccauuuuuaccagaguuaagcuaaaaguaacuaaguugagcugauuauuaccagguuugagauccuuuucacuauuaauuaauuaauaacaauagcauuagcuagcauuaugguugcaagaugcaucuauauuuuuuauuuauuugacuuaucuuugcuauaucaccacccaaaaauuagacaaugcagcaauuccaguucuuguuuugugggugaaaaaaugaaagcauuuuggcugguuaacaaaucaaguuagcugcaaaauuaagauuagacaagaagcaucuucccacuauaccuccauuccaccuaagauaaacaaaaagucugacauuauaauuuuuuucuaaggaaguucuuuuuuuuuuuucaauucuuucuacuaaagguaggaauuuucucugaaaauuauuuauuaaauuaaaaaucaugagaaaaaugacuggauauuuauggguauaaggggaggguguauuuuaugugcuuggguagaugugugguaguauauguauguguacauaucuuuaucuaaaacuuuuuuuucugcugcauggacucuauuuucuggccuaauuauucuccauuaaauguucugaggcaucugaaucauuguucuaaagacagaagggcacaaaaauggaaaguauauuggguaaaagagaacauguaugcaauuuaauuuuagcacauuuuucuuccauauaggaagaauuagcaaacaccaaacugcacuguuaucuacuucucccuucuuagaacacaggugucuucuuccuaagguugcaaagaauauuucacuugcuauauccucuaauucugacauugaaacacuaaugaugaaaguuaaaaauaagauucuguuuugguuuucaggaaaggucauaggucaguuuaagauuuauauaccaucuuagccauuuaauaacauuuuuugauacugaaaaacuuuuuaaaagauuaaaaugcugagguuuuaaaaagccucauuuuuugacuuagaaaaauaaauuaucuauuuaaaaauauaaguaacauuuuaagauccaaaugaaaauuauugaaaaaagucacugaaaagaaguuuagaauaaaacuauacuaaaagugaacaaacuuaucuugcaacuauucaauauugaacaaauauguggacaaguauacaugagauuguugucagaaauuuauguucuguagaaaguaaguugcuacagcguacagagugcuaagucacucucuaaacuuccuaaaacuuugccagcuucugcuuuacccucuuaaaauuaucuaaauuauuccauuuauuuauuuauuuauuuauaagauggagucucgcucuaucgcucaggcuggagugcagugaugcgaucucagcucacugcaaccuucgccucccagguaaaagcgauucuccugucucagccucccaguagcugggacuacaggcuccugccaccaugcccggcuauuauuuuguauuuuuaguagagaugggguuuaguagccauguuggcaggcuggucucaaacuccugaccucagaugauccgcccaccucagccucccaaauugcugggauuacgcaugagccaccacacucugccuuuuuuuuuuuuuuuuuuaagacaggaucuugcuauguugcccaagcuggucuugaaugcuugggcucaagcaauccucuugccuuggccucccaaagugcuaagauuacaggcaugaggcacugugccuggacccauaucuuaauuuaugaaaauaauaauuaaugugaaugccuaguucuguuguuucauauuaaaauguuuauaagcaauuaaucccuaaauuuuugcuuaauauauagucauuuuuccaaugggcuauuauaaacguugaauauuauuuaacaugucguuucucagguucuuaaaaaaagugauaugugacuucuaguuauuaguacccaacuuuuuuuucauaaauguucaagaagaaagguuuaauaaacaaauaaacauuagcaagauuucuuuaaacauguacucuuuuuaacugaagacugagaauuuuaaugucuguuccuauaccacaacauucuuucuugugaaaaucaucuuugaagauguacauuaugauagaauauuuuucauuguaauuauguauguaugaguaugaaaauuuucuaccaucagcaucacauuuauaaagucaaauauuuuuuauuuuauuauuauuauuuuuuuuuugagacagaguuuugcucuuguugcccaggcuggagugcaguggugcaaucucagcucacugcaaccuccgccuccuggguucaagcaauucuccugcgucagccucccaaguagcugggauuacaggcacccgccaccaugcccagcuaauuuuuuguaguuuuaguagagacaagguuucaucauguuggacaggcuggucucaaacuccugaccccaggagauccacuugccuuggccucccaaaguguggggauuacaggcgugacccacugcgcccggccaagucaaauauuuuguauaaaacaaaucugccccaaaauuguuauuuaacaucuucacuguuuuuuguuuuuguuuuuucuuugagacagagucucgcucuuguugccugggcuggagugugcaauggcacaaucucagcucaccgcaaccucugccucccggguucaagcaauucuccugccucagccucccuaguaacugggauuacaggcaugugccaccacguccagcuaauuuuguauuuuuaguagagaagggguuuccccauguuggucaggcuggucuggaacuccugaccucaggugaucugcccuccuuggccucccaaaguacugggauuacaggugugagccaccacgccuggcccaucuucaccuauuuguuuuugccuuagaggaugucuuaguccauucaggcugcuauaacaaaaauaccauagucaggggugaggagggguucagggaauauaacaacgaacauuuauuucucacagucuggaggccgacaaguucaagaucaaggcaccgguagaauuaaagucuggugaaggcuuaccuuuuggcuuauaaaggcagucuucucucuguguccucaugugguagaaggggcaagggaguucucuguggucucuuuuuuaaggacacuaaucccauucaugagggcucugcucccaucaccuaucccucccaaagcccuaccuccaaaugccaccaccuuggggcuuaggauuuuaacauaagaauuuuggagugacacaaacauucaguccacaacaggggaaaucugugucuuuuacacuuagaacuauuaaaauucuuugucugaaauuacauuuucugaauaugaacugauuucucugcacagacauuuauacaggagaaacugcuagcagcuuuaagaguuaaaccaaucauuccucugcaugccauacuugaaaaugagaaaauaauccuuagcuuugaguaaaauguuuaaaaguuauuauggauuucuagucagaaauuauuuugcuucuaucauuuuuaaaauuguauuucuauuccucuguuuauacauacauuuuuaaauugcuucuagucuuaccaaaacacucauaacauugaugguugggcuaucuaaauggagaucuaaaauugcacauguauugaauaaaaaguuauuuaaaaugauguaggguaaguaaguauguuguugucucaaucaaaaacaaaaccuaucaauguuugcuuucacaacuccuuuucaacacugaagaaagacaggaagcccuugucuauuauuuagaaaaguauaaauuacgcuauuucuaguuuagucucuuuuguaacaggacaauaagaaguacccaaguuagcagguaagugcaagucagagaugagacucuaauauggcuuuugaaauuaugaugccagugaaauaaaaaagacuaaguaauaugaaguuuugauacuuagaauuccauaacuuggucuuacugagcucaucuagaauaaauggcuuuauacuguuuguccuucaagguagaaauuaaguuaaaauuuuaguguuagcauuuucacuggcaaaaggcacaacauaguguaauuauuggaguggacaauaaucuauucugaaaagaagagaaauugccuccaaauuuuuugaugaucguugucagagaaagcuauauuguuaaauuguuuuauagugcccucauacaccuuuuuucccaaaccguacugaaaugaauuauaauaaucauuguuaacauucuuuuuguagugcaguaaaacaguaauccuucagcuaucugaagaggauguacuuuuaaugggcauuuuucuuauaguuuuucuuagucaugaucacaaaagcccugaaguucccaguuaugauguaugguucuaguuaguggaggcuggacccugaagagaaauaggaaaaugcagcaaucacagccucuuuaagauuuaauaguuaaauguaauguagaaucaguauguaaaaaugugacaaaucuuugcuugaacuuauggacaagcuauuacugcacagauuugguugaagcuuuaccuccaguuacuuucuccaaagagacauauguugucuuuauugaguucaagcaguuagucuuaauaucacuauuugauuaaauauaugcaaguuuuggaagcuuucuauguuuauggacaagugauccucucaggcuuugccuuauuucugugacucagagauaacaaaauauaaauucuaaguccuuucuauuuuuuaugaaaccuauuuguagggauuugaguuacagaaaaauacauacuuucuuuacauuuaugaccauaacuaacaacagggcuacuaaauaggaaauuuagugaaggucacucagccaugaaccaaugugaguuuguuuuuaauauuuuauuaaauuuuauucaugugccagguuguuaggacacaaaaagggaaccagaaaucagacaguuguuuaaaaacauuaaacacccugaugagguuugcauccuugugguuuucucugcugcccugauaguucuuuaagguucugucauuuucaaucaacagagaguacaugugaucaguauaucugauaaacuugucaaugccucuuugaagcaguauucccugaccuauucaagucagaccccccugcuucauuucaaguaucaucuugauaagacagagcuaugucacaggcagcuguguauagccagcucuguguacaacuaauuugugcaggaaaaaauuaaaucaggagguaaauuauuucaugauugcucauucccaacagaguugggcaucauucugaagaaaauaucaaauaauugguuucagaccgugucagacacaugcaauucccuucucuaauggcugugugugguagcaccaggccucaggggucagcaaggaacuggaaauagcuuagugccaggcucggcaauagagagacagagcacauaggaaaugaaguggcaauaagugcaauccauaggggaaaugugcuucacuuggaguuuaauauaucgguucagaaucuggcaggaagccaugcaacaauuguuuaccuuuuugucagcaucugcaucuguucuguuuuguaaacagcacuuaacucucagccgguaaaugcuggaaucaauaacaacuguuaagggauuuccuuacuuccccccccuuuuuuuucauauucuaaaacaaaugcacacuacaaacaauguuugccuuagauuaacaaggaauagacauuaacagggucaaagggauuugguugggaacauuuuauagcuucuuggguguacaguaauuauaucugugugauuugaauguauuuuguaaccuauccaaauuaaacuguuaaaaaaaugcuagcaagcaguaaugaagaugauuuuuuauaauuaucuuacauacuguguauagaaaacuccuggcaccauuuguaauaauuuaguuuugugcaauauuguguauuacagcugcuaugcugaaauauuaaguugccuuuugcaguuuuaggaaauuagugauuauauccagcaguacuaauuauuuuaaacauacaguuagcaaaaaaaaaaaaauugcauaccacagugagacauaaaaaaggauugaucugugacuggugccuauaaaacuaaggauaucauuaguaaauggaaaagaaaaaauaacacuacuuuuaaguucaccgucuucaagacagacugacuagaugaaugcugucauaaauacagcauuauuacaauaguuauuggcaucacuuaaaagugaauaucacuaagaucagaggagcacauuauugcuagugggauuuauggaugcaucucuucauguucuacuuuggaaauuuacuucaaaauuuccacauauacaauugcuaaguugccuuguuuuuacuuuguuaaacuacuucauaucugauuuaaccuaaccguaauucuguguucagaacuuuguuuucuucugcuuuuccuuauauagugagcauuagaucuuaggcuuuuccuuuuuuuuuuuucucagaaguaugauuucuuugaacuuuucauuggauuaccauaaaccacaaauaaaauuugagaauuauuugacugggucacugagucaagauuugcauucuuuugucuuucuuuauuuuauaugucaaaguggugugaauuuuucaauuuucuuaaccaucauuuugcuaauucaccucuuuaacuuaucuuggccaagacauuuuugauagccugucagguuuuuuuggggggggcggggggacggugucuugcucugucgccaggcuggagugcaguggugcaaucucagcuuacugcagccuccgccuccuggauucaagggauucauucuccuggccucagccuccugaguagcugggacuacaggugugcaccacuaagccuugcuaauuuuuuguauuuuagcagugaugggauuucacuauguugaccaagauggucucggucuccugaccucaugaucugcuugccuuggccuuccaaagugcugggauuacaggcgugagccaccgcgcucagccauucugucaguuuuuaauaaaauauauuuaauuagaaauaagaauuugagaauuuggauaauaucuuucuuacuccuauugagacuagaggauacuuuggcuucauuuucuugacuauacauaacacuuauuuuuuugguauuuuguuguguaugauacuaguuacuauaugauaauauaaugcaauuacgaguucuaugcacauauaaauucacuguuaucaccucaagugucuagauuuuggugcuuucaucaucaucauaagaauuacaauccauauuucauaaauuuguacugaaacugguuuauuccaaugaaguguggcguguuuucaggcuuagaaacuagaccagaacugccuuuuauaaguauauucuauccaaagauagagaaccuacuuuauuaauccauuccauuaugacauuuacaugauucaguaaaaaugaaauaacauuuaaaacaauuauaugcccccauuuguaaauauauauuuuuaaaaaguauauuuaauaguuuugucuccagaucagaaccugccauugaaaaccauggacaaaauuuagaagccaacuuucaccuuuuguaaucacuuccuuuauugagggaaaaaugaucacacauuaccagacucucuacaaauuuaaauaauguaaaagugaaaaacuuccauauucacuuccauaguuugugcuuugccucuucaauaggaauuaauaucucacuuuugucaucuccuguuacauauucuaaaucacauccuaaucauuuaguaugcaaguuuaaaacuguucaaugauggaaauuuucuuaccauaggucaaaguguucaaaguuuuauaguucuuaaaauaaucaaaguagcuaaccuguauuuauguuagcauuaaaguuaacuaccuccaacagugcuugaaaaauuguagugguuaacacaguauauccugauagacuauguaaggcauucaugcgggauggguaguaccuauugaucauuggcuaauuuuaaaaaauugauugugaaagguagcccuuuguuguauuaggugaaagcaauaaucauuauucacugagcaaagggaaaauuaaguacuaauuagcaauuaugaagugugcaauaguaguuaaaauauaaggaguauuuucccacugguagcaaaugcuaccuggggacaauagucaauagauugauugcugauagcuaaacguauuuuucaaacccaaggaaguaauauuaacucaggacuuucaguuuaugagacugacaugcugccagcugugcuaagaggacagaaccuccaaaaaguaauauuaaaugucaugagaucgaaugacucaacauuauagcagugucuguuuugaaaucuuguaaaaaaauuagaauuuucugguaaauuauuuuaggauuuaucccaugcaauuauuauuuacauguaguaucuuuaucauuaauuugaccuuuuucuuuaagaacuugaaaucucuauucaguuaguuuuauuuccuuguuuuuuauuuaagacaaaucuuugaaaaaaagacagacaucuuuauacaaauuguaaaagaaucugaauguaauuagcuuucauagucaucaaaugaguguugcuuaguuuucuguguuuucaccauuugaaucaucuaaucuuuauuggugguguaggggggcugacauauuuuaugcucuuaguuaugccauaacuuugauuuaaucuugaaaauuggccuuucagauauuuuagguuaauauccccaugaaaaaaaggggaugaagacuuaugagauuaacuuuuuuuuuuuuuuuuuaaagacagagucucgcucugccacccaggcuggagugcaauggugucaucucugcucacugcaaccucugccuucuggguucaaacaauucucaugccucagccuccccaguagcuaggacuacaggcacacaccaccaagccuggcuaauuuuauuguauuuguaguagagauaggguuucacuguguucgcuaggcuggucugaacuccugaccucaagugauccacccacuucagccucccaaagugcugggauuacaggugugagccuccgugccuggccugagauuaacuuuuuaaaauaucacaugggugaacugggcacgguggcucaugccuguaaucccaguacuuugggaggccgaggaggguggaucacaaggucaggaguucgagaccauccuggccaacauagggaaaccccaucuuuacuaaaaauacaaaaauuagccagguaugguggcaugcaccuguaaucccagcuacuugggaggcugaggcaggagaauugcuugaaccugggaagcagagguugcaguaagccgagauuacgccacugcgcucuagccugggugacaaaacaagacuccaucucaaaaaaaaaaaaaaaaaaagaaaagaaaaaucacacgggcguaauucuaaauguuaacuuugauuuauaauaaauacaagagaauucuaaucaggcagccuguguuaauaaagauuuauaauuuaucugggaaagaacauauauauacuuuuuuucaauagcuagaauuuacacacacuaagauaaaaucuagccuucauguugaaucacucacaaaaauaagaauauuuaauaccauuuuggaaucacucaugccacuugggacacaaauaaaggagcgcagacuauuucccuaauuuaucauaagccuuuuggaguguucuagccuucaagggaguuccaagcauuuaaguuucacuuugauaaaacugggcaucugggcccacuaagcaacuaucauggcugcuuugauccucuugcuuggugugagugagagcacauucagcuaaugauuaaagagaggugcuucacaauguucacuccagcuuauugucuguugucccucuaccuacuugagauaauuuaguauaaggcuaagacagccuuuauucuuauacaaaacucccauuuauugcucaaauuugcuucuuuauuguuacuuacaaugaaaaaacauggagaaaugcgaucuugucaauaaaggccuuauuuaagauaauuuaagggcucugauaauauccucuuuauaugcuuuguuggaaguagagcaauuuuaagcuaaucgaauugagccccuuucucucuuaggucccucugcauuuuggguccaugucuaugaucauuguucuugauacacaggcuggagucauaggcuucuucugcagcaugcucuuucagugccuugcuacuuugaacuaaagaugaagucuagcucugagcacucugaacagauggcuagcuuccuggaagauggccaagauuggagaaugcagaguaggcucuucuuccuuaggaagauauccuuauuugcuucccaguggcaggacuuuccuucagaacccuugggaaagaucagagagguucuuguguuggucuucucuaagacaaccaagaagggaaguaauaguguuuaaggcaugagcaugaguauggaagcaagagauauugucagaugauggagaaguaguguuagugcuaugggaagagcuacagcacaggugagacauuccugucagcaacauucuauucuggugaggacauguguccugauuuguaaggcaguggggucucaccaggggccgucucagucaaagaagacagccaaguucuguguucaugagggagggaaugggaccagagaagaaguggauucacuuccaaaauguaaccaggagcauuucuggagccugguuuguuuuuguuugcuucagaaauaauauacauuugugaaaaugaaagcuuuaugaaagcuugaauguguuuccucaguauuagcaaggagaaagaagugauaaaauagagauugcuuauuuagauuguucaaggaaguguuauagggaauucauuuauuuaucaguuaggagauuaugugaaaagggccuagauuuacauugugggaacaggaagaaagagaaaaacugaaaauuggaaaacauauuacaguacuuuuacuuuuuguauagucuuuagugcaccauuaaacauggaaaguuaugcuaauuuuauauauauauauaucauauauauauauauuuuuuuuugagauggagucucacugcaaccucugccuccugcguucaaucgauucuucucccucagccuccugaguaacugggauuacgggcgcccaccaccaugcccagcuaauuuuuguauuuuuaguggagaugggauuucaccauguuggccaggcuggucucaaacuccugacuucaagugauccacccaccuuggccucccaaaaugcugggauuguaggcgugagccaccgugcccagcuaauuauauauuuuacaaauuuuaugaaucugaaguuuauuauaggguacacuugcagacuucauuauauuagauauugauggucugaaauaaagugacaagugauccauuccuaaaacugcauuuuguuagaaaucuuuuuauuauguugaagaaauaaucaaagugauacauuucuauuacaaaaauuaaaaaaucaaauauacaugaagggaaaugucagcauucucauauugccuucccuuugauucuguuucccaggguuaccauucuuauucacacuuuguuuaauaguuuagaauuuuucuuaugcacauauaagaauucauauuuguaacuuuuaaaaaugagaucaaacuagacauauugucauguaaugugcauuuuucacuuaauauuuugugaccaccuucaauuucagugcaauugggucuggcguucuuuucagcacugccaugauauucuauaauauagauguugcauaauuuauuuguauaucacuaaguuuaaauuuaucuuaauagauuguugacuugcuggauuuagaaaaauauuaauuuuucuucucaaaagcauuauaugcccauuguuauauaaacauauuaaauucauguguguauguauguauguauguguauacauacauauuuaaaguguauaaugugaaaaguauuaggucuuauuuaccuuaccuacccuuaacccuaccauccuaaaguaaucccuguuaauaguuugguguguacccuuacacaauaaugcacauacuguacauguacauucuacagauuccuuugcaauuuuuuuuacuuauaucacagaucacuuuuguaucaauacauauagaaugaucugcauuauucuuuuuacaggcugcaaacuaugacauauguauuauaugauuauaucauuauucagucauuuaauuaaccaucucacauuuauagacauuaggauuuuucuaguuucuuuucuuuguauacuuguguaucuuugaaagucuuauuccuugaagugauauucccggaccagagaguaagcuaauuaaaauuuugauacauauacucaaauugcccuccaaaacaaauauaccuuuaacuaccaauauucagaagcaugaauaucuagauacauucauugagcaugaauaucuagauagauucaucaagucauuaauuaugauuuuuuaaauggguugaaaucccugugcucaccugaccccucuugcaucauccucucauugcugcaaaaagaagccuggacaaaaggcaugggagugagggauggccacguagugcucaauguccuguagcuauuaggagcuuuggagucagacuugucuuuguauuccagcuuugccacuuggcaguuauguaaccuuggauagguuguuuuucuucuaggagugccuagacauuuaaucuggaauggagaugauaaaaauaaaaccuuccucauagcaucuaaguauuaauauggcuauuacacauaguaucuggugcaaaccaauugcuuuguuauuaucuuuauuuaaaacauauacauauauacagacauauguauacauuuauaguauuguacugacgaggugacuugcugucauauguuaaugugguguucccaaacaucaauauauagcaaauggcugcauauuuuuuuauuuuuaaaucaaugcacaaugaacacuuuguuuuaucuuuaaugugccucauauaauauucucugaaagugcuacauuaauuuuuuuccauuuaaaauaauaguagugaaagaggcgggugcaguggcucacgccuguaaucccagcacuuucggaggcugagguggguggaucaccugaggugaggauagugaaaccaugucucuacucaaaauacaaaaaauuagcugggugugguggcgggcaccuguaaucccagcuacuagggagacugaggcaggggaauugcuugaacccgggaggcggagguugcagugagcugagaucgagccauugcacuacagccugggcaacagcagugaaaguccaucacaaaaaauaauaauaguaaugaaauaagaugaaauuaaaauaauaaaguauccggagaucucuuuuguuuaucaugaugauuccaacagucacugugugugaaugauugccagauccagcuccaggacugaucucgcccuggagauucauacuucuacagcuaaaugccuguuuguuuggucccuuggcuauuccacaggcacuccaaacaccgcauggauaaaccagaacuccucaccauucccuggauccccgcuucucuuccccagucuaaguuaaugcugcuaauaaucacucacccagaaacuaugauucauucuccccuucugcccugcuccucaccgucaaaagaaucaccaagauuuuacauuuugccugaccaccuaaauauuuccaagucuaucuccucuucuccauuucugccaucaaggccuaauuuagugcuuuaucaucucucauuuggacuuaauguuaaaauacuuuugucuugucuuuucauugguuucucuacccuuauucuugcuuuccucuaagacaucugccaaguacacuuuacuccccuauuuaaagcucuucaguggcuccucaucacugucaucauaaagcuucagaggcuagguuuuggaaagcaagccuuccuugaccuagcaccugcauucucuagucucaucucaugccucuccccaccucauauuuuucacucuccaguaacacugaacugacagaaagcucugcucaugaugucgcgugugccaccucuuacucucuucauucccuuccuugccuaauuccuuuugauccuuuaugacagcucaugugucauuucuucuaagaagcuuucucugagcuacagccccuaauccacgcuccuacagcaucuccauaugccuuucucaaagcuuagcauauucuaucaacauaucuaauuagggaucugucuccccauauggacucuaagcaccuuaaggacaagaauuauuuauuuucuucagcaccuaauucacugccuaauauaugacaggaguucaaugaguaucuucuuaacugaaccauuuucuuaaaauaaaucacuaucuggaaguuuaauaaucuguauugguacuagccagccaaacgacuuauuaauugaaacucaacuauuuaaaaaauauuaugcuaagauuaauggggauuccagaaaguguaagacccuugguccccccccccccccagauugggaaauaaaauaugaauauaugaaaaauugcugaaguuacacagacaagcaguugcagaguucugagaagaaagcgauuccaggaaguagggguuccuucuaacuuaugcccaggaugaucaagaugaaauggaaccguguugguugcagggugggcaggagcugaagaagcagaaaacaagaauugaugaacaaaacaguauucacuuucugcuguuuucccacaaugcaggggggaaugcuggcucagaaauagaauuucaacaugagggauguucacagcauggagaguuuacuuggaaggcacaaaacagaaagaaccugggccuuguuucucaggucuucuggcuucuuucauccugucacucaacccugagaguuccauaugaugucugauucuguagcucagucccacucuccaucccagcuccacccuggagcaacuaaucauauuucuuuugaggaaacugcuuugccacgagcaauuuuuucuaaaguuugaaaucaguuuaaagccugauuuuauguggugucuucaagugccuucaaaucuaggagguaaaagaaaaagaugaacccacaaagcaauauggggagaaaaaccuuauaagaccguuuuaaauuaauuaccaagugauuauuguaagacuuuaaacacauuaggaauucagggaagggagauuuuaguguaaagaagggcaagcuagaaaaacuucaugaagauuuggacucgaguuuggcugugaguagaccuugcauaagcagaaguaaaaugaaagagcuucccuugcaguccagacaguaccagcaguagagauuacacugacuuauuggagauaguggagaaaacugugacuggcgcauaggagcuauccuauaaauaauuaaugaagccauuagccaggacucugaacuuagaagugacaucuuuguucuuccauuucucaucucugcuucuuaugcagaaaagggaaggguguuaauuaaaagaagaauguuguagauuacacaauagaagaaagagcuaaauaauuaaacaacaauuaaaccucuggaagaaugggcaccagaggauucuggagaccugagcaacaggaucuuagccuucaacuguauuuuaaucaucaauuguuuugguuucucccuaugugaugacuucacucugaccaguuucuccacucaguggguacauggcuccuggcaguuuuuugcucauauccuaacagcuuccugguaccucaguuuagagagucucagggaaggcuucugauuggcccagggauaagcuuguuauuagaagagcaaaagaagugcugggcauacaaaaacuaagucaaauaaaaaguggacaacugaaugaaugauaugauaugauaccuagccuaagaacagauuacaagagucuugaaaaccagucuuugauguuuaaauuacaccugguagcuguuaaagucuuuugagcagaaaauaacuugauagaaguguuuaagaaauagaacuuguccaguuauguguaagauuaccugaauggggagaaggauauaaagaaaccaccuagaagaauauuucccccaccccacugccuggaaauucuagugugaauuuuaaugcgaguuuaugcugaggugaagccauaaacauugagaacaggauggcuaggugggaauacaaagcauuaacagggaagcaacagagcaauugcucagagugugguuucuaaauccacagcagcaucacccggaauaagcuagaaaugugaacucucagguuccuccgcuaacucacugaaucauaaacagugggagugggccuggcaaucuguguguuaacaagcucaccaggugauucugauacaugcuaaaguuugauaccaacauaguguacuuucaacugauuagguggguguccaaaaguaauugugguuuuugccauuaaaaguugaaaguauggauuauagagccauucaaguccuggcucugugacuuguuuuuuauauuuuuuguuuguuuguuuuacuuuggggcucugugacuuaugaguuuugugaccuugagcaauuuauuuaacuuuuuugugucuuagagguaaauuguaguauucgugcuuuccaccuauuuaugcuaauucucuaauauaauucucuaauauaaauuacauaaugcuauaguaagcauuauauaauuauuuucugucauuaacauugauagaacuugguguuugagggcaauacgcaaaugaaagaugauucuggcugaagugugcauuggcucucauuggugaccaaaaauuguccauauuauuccaaaaugaaucucacagauugaaacuguucauauaaaucaccuccugacccccauacuuuguucuucauuugaugucauugcuaguuuucucagaguggauuuacuuugucacucacuagugaguaacuuacuuuuucugaccuucaguuuccucauuuugguuuuaauuaagauuggaaacaacauauauaaaguucuuaccauauaguauguguucaguaaaugguaacuguuaauuaaugccguggcaaauccuauuaaucccaauagggaaggcgccacguucaagaggccgaagaagagacucagagccagcaaaugagacaugggauuuuaucaggggcucacauauaggggagagaguccggugacagugggcuggacaggaaaaccgcagcggcuugcaaacaccaugcuauuuauguagcauuuucauuuaauacccucccugcuaacaaccuccaccuggcaaccuccauuuaacccaaaauucagggccucaauccccuguacagucuggcccauguuccacgggacaggcuggagacucagauguucaucauagauaaagaauaaaucuuuggcuuggccuucaaacuccaaauaugacuuugcagccccuugguggcagacauuccaccuagcucagaacacacauuuagguucaucugccacacgggugcauucgaaggauauggguacauuauugcuaucagguacaucuacccuaccauuacucuuaucuccgucaucccacccccugcuuuuuaaccaguuucugccuuugugugucaguaaucuauaacuguucucuguuuugcauucuuucuauuugcugagggcagggguugacaaacuuuuuccuuaaaggauaaauaguaaauauuuuaggcuuugcagcccauaagguaggucccuguuucagccacuucacuuugccauuguagcgcagaguagccauagaucaguggggugguguuucagugauacuuuguggacacuguaacuugaauuuuauguaauuuucacaugucaugaaguauucuccuuuugauuuuuuucuccauccguuuacaaagagaaaagccauguuuagcuugccaacugcaccaaaauaggcucugggccagauuugccccgugagcugucacgugccaaccucucuuugaggggacugccucuccccuagccucucaccaccuuucccuuuuuaucccuucccaccuacucuugucuucccuucuucaucacaacccagccaccaauaacacuggaucuaaaaugcaaucuaagugaauuuuuaaauauuuguguuuauuaaacaaagcuucauguguuauuacaauauaaaaaucaaauaagucuaagauuugucuauauacucaaauaaaaacuaaguugcuuauuuucacauguauuuucuauuguguuuuucaauuaaagaauucccaugaaacaaaccauaagugagcccaguauuaaccaguuauaucaaaauaggaugacagucaacuccagauauuuucugcaauuaguuucuuauccagacuuuuuucaacacugaguuuuucuuauguaucgaguguaaugucuuucuuuuugccugaacuaaaauaguuaaagagaaguaaauuuauucucaugagccucggauggccacaggagcugauggugacuggugagguauggcccuccuuagucaccccacucugcuuucagaucugacucuguaccugucuccugucacugcaggugaugcaugucacauggugccuugugcaugacaggcacaaaguaaaucuuuauugaauuaaaaagugaaacccacuuaaagaugcuuuuuguagaucauaggccuuuggaggaaaaagauaaugucugccaccaaggggcugcaaagucguauuuggaguuugaaggcaauaggaucuuaccuuuauggcugaauaacuauuguuuaggagaggaaggcagcuaaaaagguaagauuaacuauaaaauuuacaaagugccaucacaccugagacacgucuucucuaccucucaggccugcccuacucuuuuagaauaauaagcucaugaguacagcuuuucaggugggcacuagggauugcuauuuucaccauggcuaucucuuuucauauucauuuuaacauacauucaugggcauuauaauuuuccuaccugauaaaaaagugugaagagaauguuuucuuuauuuuucauuauagaggaggaaaaacgugccacuucuuuuaaaaggcugugauucgguuggaaaguguauuaggaagcacacucagcagaugucuuaacugaaauccaucuuuuugaugauggcauuaauuuuauuugagugcuaaauuuuuaaaaauaauuuuuaacauguuauauugagagcugauaauguaacuucucugucacggcauauuccuuuaaaaaaugaaauauaaauucucagguucaaucuuaggcuauaguaaaaaugaauuguuaacugaguuuuaaguuuuuucuacagguuaauuuuuggucaugaugcgagaaaguaacacauaugauaagagauauaauuaacugaacucuugcaaaauuugagaccaagaaagggauacuaggaagauauuuucauuaauaauguaccauuagcauauaguacuuaaaauuuaaaacccauuuuaucacacuagagaugucuuuuuauuaggauguucccucaaagugucagcauaucuaagcauaucuaaguauuuacaacugggaguuaaaccagcauaaaacaaaagucagcugaaaaauauucagaaauuugcccugaauacaguucucaguuuuggcugaauucaaauguaagccauucuuugauuagcaucuucaacuaacaguggccuaaacuggccacaucaguaguuagauauucucucucauguucucagucaaaaaaaaaaaaaaaaaaaaaaaaggauugaauauaggagagggacaagaguauuauacccuugggaaaugagcaagaagucagauuucuugcuaauguaauacugacagguuuugccagagaagagggaauggagugugggagaauuuuguuaucauugagcaguaaguuuagguaacauccaguggagccagcauuggccugggaaucauaaaaggguaagaauagaagcagugucuuuucaguuuuucucauugacccagaagaauagcuucagggugacucuaucuucacccuuuuuagccacuuagguuucucuugguaugugaaacaagaggauauuuacugucuggaccccuccaaaggaaauagaaaaccucccugucacguggggccuuucaguggguugggaggaaauauuucaaacccagggguucucucugucuauacaucuaccucucuuuagaucaugauuacuacuccuaucaaugggugcaaauuuuagugcaacaacuagaucagagaaagaagguauaaaaaaugcagauauuggccaggcgcggugacucaccccuguaaucccagcacuuugggaggccgaggcgggcagaucccaaggucaggagauugagaccauccuggcuaacauggugaaaccccgucucuacuaaaaauacaaaaaauuagccgggcgugguggcagaugccuguagucccagacacuagggaggcugaggcaggagaauggcgugaacccggcgggguggagcuugcagugagcugagauugcgccacugcacuccagccugggagacagaggaagacuccgucucaacaacaacaacaaaaaaugcagauauuguauguacuagcaauucagccucucuaauacauauuuugguugucauguaccucuauggaagcaguugcuacuuugugcuaaucaguguauuugucuaaauuccugaaagggugacaccauuaguuauuuuucaguauaucacaucaccuuacccaaggccuauauuguaauaggcuaagagaauuaucuguguaaauguguuaagauauuuaauuuuaugaaaugggaagagugaugaauuucugagguggaagcuggaaagcacuuauucuugcaaagggaaguagaaacuucuagaaacuacaggucucuugaaugagagggagauuuauagggucuauuucugauaaagucagaccagaucaaggcagagggccucagccagaugaucaggagaacucuaaggccugagaaccucuuggaauuauaugcaaaacauccuucuaugaacauagaugcauagcuuauauuagauucuaaaagaugaugaucacaugcacauacacaaacaaaaccaguguuuugaagaacugacgccguaaagaugcaauggaaggucuuggaguggggcugccauucaacuucaugaauguuaaccuuagagauggagucaauuaaauaacaguuaauauuuaaaguaguuuauagugaaauaggucucugauaugguguuuaucauuauuucucuccaaaauauuuccuguuaaaauugucauacaguaauuaaugugaaacucauuuaguauuuuacuaaaagaagcauguuuacaauggagggggagaaagccaauuaaaauaaguuaaaagcaguugauuuugucucucacacucacuagugauaccccaaauguaccauuuugaagccauucauucauauaggcacugugauggauaaugggaaugcagucaugggggaaaaagaucucugccuauaaggaguuuaaaguuuaagagacaacuuucaaacuaaccauuguaaugugacaugguaaaugcuaaaaugaaggguugugcaaggcaaaauaggaaggagcauggagaacaaaacccugaccuggcuuggggucugagggcagguuucucagaggagaugagacuaaaaucuaacauuuguauagcaaguacuaccucccaagaacaguucuguguuaacucguauaccauugagacauaaagagacuaaguaauuuguccaaagucauacugguaguagggacagugcccagauuugaagccaagccaucuggcuacagcuucuguguguuagccccuccgcuaugccaccucugugcuucagguaacaaugguauaaauaaacauaugauacaauugguggugggauggcgacaccagaaguggggaaagacagagagaggaggaggaguccaacuuuuagcuucuaagaguuaaauguuuucuaaauucaaaaucagauucauuuacauucaugaggcucaguuuccuuaauaguuccuucuccauucucucaccauucagaagaggguuccugacacuuaucuguggguuaucugaauuuucacauauucagcuuguguuggguuacauuuucacuuaacuucauagauauucauuucauucuuuuaaucauuuauuuacucauuuauucacucaauuuauuucaaaguuuuaccuuguguauauugggugguacauacggaagccuccucaaaagagaugagaaguaagaaauucaguucugcaaacuaagguguaaauauuccuugucguacuuuuaccccaaauucuuuucuagucauauaaauucucaaaauaaguaaaaguuauaacaauaaugccucaagaaaaggggaaaaacaguuucaauuucaucuuagcguucaugacaaaaacaaugcuugcagguccuccaugauuuucuagcuacuagugacacagaaggcccuuuacaaacucaggaucaugguguuugcguucuguucuuuccccugcuguggcuccauggaaccgagcauuugaggaggcccagugcuucuucagaccacugcuauccauuuagugggcucuggagucccacuuccucucaggaagugacuuggguccugggagaaguacugcuuauuguuuguuccuacauggucccugcugacuucauauuauaauauucuuuaaaaguuuucuuuacuggagcgaagaucuuccauuuguauuaugucauaaauuucaccuggaauaauaagacuuucaguagcuuuugugugucaccucuuuuuacgucgcuugucugguggcacugagaauaccucuucacugaaaauggauccauuuacagucaauaauaggguggcuaauguucguuuuucuugggaaaacugaaaugcgcaccuuuuauccuauuauacugauccuccagcuccagauuaucugauuguguagcuucucauuuucucuuguaucuuaccacuauuauuaauaagaauucuguugcuaauagcuuuggaaaauaauaugugugcuugcagccacuaccuguauuuuuaugguuugucugauuuagcuggacuuugauauuuauuucaaaugcugcuuuguugcagaucaaaugugaggagaccuaaugucccucuagauuuauuuucaauguccuaaauuuugcuagaagagaaugggguuaauacuugaacuacguauaacuaacauuuaacaccuuuaaguguauaaucuguagucuauauucuuuacgugugauaugccuauagauauguguauguguauauaucuagacacauaucuauaauaccuauauauauauuuacaaauauauauagacagagaagaagacuuuuuuaaaaauguaggguaacaguuuuguaaauaucugugcgcaccuuuuauggugaaauuucuuuuuccuaaaguauauuuuauuuuuuuaacacacaaaagucauauuuuagaaaaaauauuaucaauauacucuaucaaguucccagcccaucauucuuuuuauagccuuuugcacaugcuuucuauuuuggaaguaaucuucaaauuuauuuugucaaacagaauacuauaaggaauguuuauagaauauuguaaauauuuauuuaugaacuuaaaaacaucuguaauuauuuauuguuuuaaagaauacauuuuagguuuugguauaaaaucuuacuuuguucuggccugaaccuaacuauuucuaggaucgaugggauuucauucacuuuguuuuuuuaaucaguguuuugaguaccuacuuuguaugagauuaugcugaguucugcgauacuauggcaaauaagcuggauauagucuuuggccucauggaaaucauuuuacacuuguguugacugugucuaaggaacuucaacuauucuuuagguuuuuuuccuaacagcaguuccucuuuugcccagggcaaauauguaggcuauauucuuagaaauguccuacagauguuccauacuucuucuaaaaguaaaaaagucauaaauuucuugacauggaaaaaguggauaaaaacaaugccugcagguccuccaugauuuucuagcuacuaguuagacuuccuuuucuuucuuuuuuuuuuuuuuuuuuugagacagagucucucucugugucacucaggcuggagugcaauggcaugaucucggcucacugcaaccucugccucccgguuucaagugauucucaugccucagccuccuaaguagcugagacuacaggugcacaccaccacgccuggcuaauuuuuguauuauuaguagagacaggguuucgccauguuggccaggcugaucucgaacuccugaccucaggugauccacccaccucagccucccaaagugcugggauuacaggugugagccaccaugucuagccaaaaaaguggaguuuguuuuuuuuuuuuuuuuuaagucacugguguuuuaugcaauagcaacuuuuugguugacuucugagacccaaaucuaguuuuuuugaugcuuagagagugauuuuuaacccacaaggguuuuuaucuaaagcucaugaaccccucagacaggagucucaaacucuagcacacaaaagacucacuugggacacuugcugaaaaguaauauuucugggcuucgucccguagagacgcugauucauuaauucuggagaagauccagaaauuugcauuuuuaaugcuacagaagauccugaaccauacugcccugugagagccaaagauggacuucgggugguucuguuuagccuucacacugugacuacgugaacugaauucaaugagaaggucuaggaggcuuuagaagacuuuccuuaguuucuuaaaggggucugcaaaaauacuaugauaauguuagaagcagugguuuacaaguggaagaggguacugguaaagucauccauacaaccaacaacaagaaccugcagcaaaaggucuaacaaugaaaggaaaaucuguaaggcagauauaaauacucaaguuguagaggaauccagagcagugucccccacacagcuguuuuugagaauaucucagaagugaguagaucuguguugauaaacugguguucauugcucgaaaacguuugagaaacacuaaguuuagaaaguuauuacuuuauuauggcaggaaauagagacuuuaauauacuaauuagccuugugaauuacuuuaagaagaauucaguauguaguauuucccaagcuuauuuggucguagaacccuuuucguauaaucuaaaaugaaagcaauuugagaaaugcccuuuaacagagggacaaacauuagucccugaguguggcauagaaauaaauaacuuucauuauaacucuaucaugaagaaaaauuuacauuguuuuaaauacacuaaauaauaaagcagaauauuuuauauugcauauuagaaaaauucuuauuaaaauuauauauaaagaaaaaacccucaacuaucuccucauuauuuacgugggcuuacucaucuaguugaugguaaauuaaauacuuucucuaaaaugaaaauuuaauuuuaucuuuauaauauuuuggugauuuaggagaacuguguauuuccuaagaaucauagagcucaucauagccaaauaauaguuauuaugucagauauuuuacagcaaugguuagcagaaggccagacagaguugccuguguguaaacauguauguccaaaacuuugaagcacaacagucccauagugauuuaaauaaauaaauaaaggccagguugucuuagugggggaagaagaacuccuggauugauuguauccaaaaaguuuucagaagggcgcuguggcucacgccuguaaucgcagcacucugggaggccgaggagggccagccugggcaacauggagaaauaccgucucuacuaaaaacacaaaaauuagccggguuugguggcggaugccuguaaucccagcuacucaggaggcugaggcaggagaaucguuuuaacccaggagguagaaguugcagugagccgagauggagccauuuuuuuguuuuguuuuguuuuguuuuugagacagggucccacucuguggcccagguuggagugcaguggcacaaucuuggcucacugcagcuccacuuuccgggcucaggugauccucccaccucagccuccugaguagcuggaacuacaggcucacgccacuacgcccagcuaauuuguuuguuuguuuguuuguuuugguauuuuuuuuguagagaugggguuugccauguugcccagacuggcagauaauguuuucuggagagguaacuuagaggggaggagaaaacaaauaauacugaaaaaugcggaaaggagauuaauuuagccaaggagauggucaaaggaauuucugcugggagaaacucuuuccuaauuuuguuaacaauaagaguuuaagggacagagaaacauacgcuuaggcagauagaaaucaugagugaaggugugaugauuaggacacuaguccuaugagauacugugagguaaaauaagucaaauaaguuugggaaaugcuacuucauccuuugugcuuaauuucgcuuuaauuggccuuucacaaaaugaauuuaucacagaauuauuuuccccauaaauugagaaccuguacaauaccccuugggagaacacugagcugauaguaauaggaaauaaggacugcuaauuaaugggcagcucccauaaucauugguugguugggacaaaaaaaugauuagauuuaggucauauauuucauucuguccucuuacauuauuuaguuauaaagauucacugaauuaaaagaagauuuaccuuucacgauuguuguauuccuggaauacaagauucuucuaaauccaggucaugaaaguaagaccuuuucaucuagaauccucagaccucgcauaauugucagcaaguagcaagcacucuuauauaauuuugacucuuaaagauucuucaugcgguguuucuuugcuuacuuuauaaacauucacaagacuuccaauuuggaauugagccagauaaagacuucuuaaacaugcuuaauuucuagugaaacuauugagcggccuuuccuaguaaagaauuaggagggauucuuaaagccuuugaaaauuugguuuauaaacauuuuagguccaaaaggaaauuuaagguuuagaagguuaaaauagccacucaucuacauaagcaaagcuuaagauaagucaaauagaccaaaugggaaucaaguaccaacuaaauaaaacauaauauguguguucucuuuucauuuuggggcauaauauuucuggcaaagccuuaguuguauaugcugccuauacauacuuguguucucuaacaugcccauagaagaacaguagaugugaguuagauuuucauguauauugggcuaacgucaacuuagagaugaaacagaguuuuuguauuuacuugcagauuuuuuaaaaccuuuuuacuguuucagaacaguacuaaauuuuacagucuaaguugguagacagcucuuucucauaguaccugcaaagagaucaugacauuuuugguccucagugaaagacuauuauaggacuacaaguuugaugcuaacauuuuaaaguuucacugaagugaaguggaauagccauaaaauuguuagauuucuggaaucuuccuucuaccauccaugugaugaagguaaucuuuugucccauggaauugucagacccuauacaguuuuugaauagcacuuguauuuugucuccaaaggcauuuugugcuaaguuuguaggaguuuacaaauuuuccaauuuaugauuaagcuucaagcuaucucuuaaauauguuuuaauaaaaggcauuaauaaagauaggauucuuuuaaauccuuuaaaacuuggucaaaaagaccauuuagugauguaaucuaaaaugaaagcaacaaauuggaguuaagaacaugaaauaagugaauuauucuccauacucuuaaagaguauaaagggauuuuauuaucauauuaaaaugauagugugacuuuacuaguagcguaaucauaagagggcaaaaaaacaaccuuuaaguuguauuguucuuacgcaaauaauagauaucacaauuauuuagacaaguuauuuuuaaacaugacuucaugaauuauguagccuagauucaauagcuaccuuaauuugcuuuuuuuaaugauaggaacaacacuuauaaggucuuaaagaguguaucuuuaauauaguguuuuguaaaauguuuauuuuaauuucagacuuacaaaaagguugccaggauaauacaaauaauuccuuuacauucaaauuucccaaauguuaauaucugaccacauuuccacuuuugcuuucucucucucucucuuucuuugcaaaauuuuauuuuuucuugaacugaaaauaguccgcagacacucuuauguauuucaguguguauuuccuaaagacaaagacauucucuugcuuaaccacaauacagcuauauaaaucgggaaauuaagucauacaguaauagcauugcauaguagacuucagucagauuucaccaaauuaucccaaguaugucuuuuauaugaaaaucaaaugcugauuauguauuaauuucaguuuuacuuaaugucuauuuagacuccuuuagacuaggucauuuccuggccuuuguacuuccucacaaaguacagacuaguuauuuuguagacugucccucaauuuggguuuguguaauauuuccuugucauuagauuuaaguuaugccagaccgaaaaaaaaaagcagaauugcguaagaugugauuuuacaagaaaucaaauuucuauuuauaacucugagaaucgaucuaauuauuuaauugcuauauuugccugaaacagaauauucaucuccagcuucccagaagaaaagauacuccuaggagauuuuauauguauuucuuaaugaacuaauuugguuuaauuauggaggaacuuguuaguuuuuauaugguuuauggaaucacacagaucauucuaauauuuacuaagaagguaaauaaaauguaugacaguauugaucuuuucuuuucacaguuacuacugaaugcccacagaaaggaagaaacuucucucucccuuuagacaaagucgaauucuuaucgcagcucauaaaauccuuuaugaaacuggaaaaagguguucaagaauuguuugacgaaauacuuuuaucacucaagauaaccagggauacuucagguaauauccucuuuuguuuaaauuuguaaaucuauaauuucucuguguuuuugcuuccugcugcuuugaaugaaaacgauuacuugaaaaaaacacacaugaaagaauucuuuaaauaagcauuugguauaaugcacaccaugcauuauauauaaaaaugcacacauuuuuauccuucaugcuuggcaaguuccuuaauucuaauugacaaagcaucauacaucaauucuggaugauuuuuagcuaaaauuaggucaauuuuucuuuucaaagaaacacaacuagccuauggaaagaauaagcagacuggguggucuaguaucuuuucuuuugcuccuagcacccagaugaucuugagcagaacauauagucuccuuagaccugaauuuucucaccuucaaaauaaugauguaggacuacauuaauuuucucuuuguuuucuuucaggauuagaugcuucagauuucgauauguuauaauguuauauaggguugugagaauuaaaugacagugaaaauaaaauaccuaagaaaaugucuaguauaucauaaacgaucaauaaaugugaguuguuaaaauaguaauuauaauuauggaauauguuguuuuuaguuuagucuuaacaaaaccccuuugaaaaaagccaugcuguguguacugaauaauauuuccaacauuaaagguaaaauucaaagguauaaugguugagguauguucucuguuaucauaucuauauuuauaaaaauuuucauuuuccucagaaugaaauauacaaaguucuccuuuacgugauaccauaugccauucuaaggaguguaaauauauauauauauauuugcugcaucugcaaaaaaaagugaaggaagcaagugauuaacaauuagucugaaaaauuuaauccccaaaaccgaucucuugguaaaauuauuuucacuuauuauguuuacucuuguauuccuuuacuuacuuugcccacguaaguaaugucacaaaaguuauaggguuggauuuuguuuuacauuaaacauaguuuacuggccuucuuuguuucaggugaaauuuagguaacacuguuauauuauaaaauaaauaacauagauuacuuuuucaaauuuggagagaauuugaagaaaaaauaaagauggacuauagauuucugaagccaaccccaaaaaaaacccccccaaaaaaaccaaaaaaaagccaaagauuuaauuaggagagaaugggacccuuaaaacgucuuuuagauagaguuugacugugaggucaaacagaggucugaauagagaaguaugauauccuaauuauugacugacauauugguuccuggaacaguugacauuggaguugguacucauccaccgugccuggcuaagauuugucaucucucaucuacaucucuaacagaccuuuucugagguaugcaucaagaaacagaaugaacuucaaaacaucuaggcuucuacccauuuugaaucaucuuguauuaguccuaggcuagacucuugggaauuaagucaguuuugugaacuuuauucuucuuaaagucagcauaaauucaaaauuagaauugcauuaggagguauuauaaagauguuacacugaaauggccaagaauugaagcauagauuuggcaugcugacuuuagagaaaauaacaauuuugaaaaaggugauucaauuccauuagauuaagaugaggcaauguggagacuugcaaaugcuggauauuugagagcaaugguuaccauuugugaaugaaagucaacagagcaaauacauaauuugccacaauauacuguugcaaaugugucaucuuauaagcaguaaggcagauaaaagcaacuucaauaucauguuaauaauagugaacuauaugaacacauuuguggauuaucaaacacaggauguagaaggaauuucaaggggcaaguauaagaagugucucaguacuagaacgucuccuugugauauauguagucuucuuuguugaaauucauauuuuuuuggucacaaagccaagauugauuuaaugugacgcagcuuuauguaaauagauuccugagaagaaugaucuugagggaaauugucaagaaaaaucuuaaauguuuuauucaguguauccaaguuaaucaauucuuaucaaaagcauugguuucuuaaaucaggaaggaaaagacuccuugaaauggaugauuaaggaagccaacuauaucuuaacuauuggguauuccugauaguuaauguuuugcuuagaaaucuggugaggaagagaauagcggggaaaauagagaggaagucauuugguuuccugcguguuuauuuugauuggagcauauuuugcuaauaaagaucuuggaaagaguugccuacgaugucuauguaacccaaacauaugaacagaugaaaaaugaggacuuuuuuugcauugugcagauuuuuuaaaaauguccagacacuuaacaucacauagagaaaauauaaaaaugauuaaccaaauauuuuacuuuuuacuuugauguuuacuauuauauuguagacuuagccaaauuggccguucucucaguaauuugauuguagacaagagauuuuguagagauacaauaaauauuuucugagaaagaaaagauauuuugucauuauuugcuuuuguuuggucaugauucgaugguuuucuauuuuugucacuucaaaaaaugauaggacauuauuugacuguuguggugccuuacuguauuaggugaugauaucuuauggaguggccguggauuugauuuauggggcauuucuaaugcuucuuuggaauaaaguuguucuuugggcaauuccucaauuuuuccaaagguggcaucugagauuuaucuaaaccaggaggcuucuuggcccucauuuuucuuuagccccagcaaugacaaagagcaauggcugcuucaauuggauguaagaagaacacuuaggguuugucucagaagaaucaaagauuucagaucuucugaaagauuguuuguacucuuagggggucuuaagaggggucaaauggcuucuaagaguuccuuagcuagaugguuaagggauuguauuagggaggcguauguaguuaagguaaagaggcuccuaggguuuguaaagcucauuacacuaggacuuuagcuguuucuugggcagagaggucgaaggcuuccacauuggaaauuugcaagguggccaccuggguuucucuucauacuuuuucaugguauuaucucuuggauguagucucuucuacagauucagcuuuuggugggagguugcuugugagccagaaaaagaacagugaagaaaagaaagacuuguaguucccacuuagagcugccaacaaggcaaguugcuuuguagugcauacaaugggaaccuaugaacaccaauuugggugugaaaguggaugucacagggaaguacugccaaccucuacucucuaugaaagaaagcggcaguguagaaacuaaccagaaguauaaaaugaaccacaaagaacucuguaggggaagcuguugagcagcuggcauucuugugacccucugcacucuucugagguucuuaaucuaggcaugcuuuuaaagaaaccaguauugacugcaugcaaauaacuauauuuuacagugaugagccgaaagugggcuaccuucucuagacaaugauaauaaguguauagauuuuaaauacauuuuuaaaauauaugaaauaauucaucaaauguuuagaguucauagaguuuuacauugccaaauuucaacauugaccauuuugaauuccagacaaauguaaaaaugccacaauuuguuaaauccagaauauaucacauuaguguagaucccauguuaguaauccuaucuaaagaugauaacuuuugcuucccuguacagaauuaaguuuuuuuaaaccauuuuaauuugggggagagggauuauauuuuaaaggcuaucauaauugcuucauaauucauuuucuauaucuuacuguagaauugcucaccagcaagaggaaucuuggaaagcuucuuuuuuuccuuagucaucuugaauauaggcagaugguuuguauaaacaucugagcacauuacuuugagugaauaaacauaauguauuugggagugaaaugauaaauacaagauaauuaacuuuuuccguaagucuuaaacuauagcuacacaauagcagacaguuacuuccagaaacagaucugcaaagcuuauacuucaaucuaguauuauuuuuccaaaguaaauaccuucuaaaugagcuaucuauagaaaaguaaagugacauucagaauccaacuuugucccuucuugucauuaacaacuugaucuuuauuauuuuuucuguucuaaaaaacugaaaacuuuuaaauagggugaaagaguaacuacuucauacauaccuccauguuaaaaauaacucaaaaccuugucauacuauguagaaauucucuuuuauaacaauuuagaaaauguagaaacaccuuguuauuucuacuagaggaauaguuuuccauuggugcauguaucauaauuuaaccaguuauucauugauggacaguuaggauuuuuuucucucuucauuugcuaccacaaaacauuauauggcaaauuuccuuaauuauuucuuauauguacacgacuauaucuggaugguaaauuucaaaaguagaauugcuaaauaaacaggcaugaucagaaagaggaugaaaagauaagccacaaacuaagaaaaaacuauuugcaaaacacauauaugauaaagaacuuguauccaaaauauacaaagaacucuuaaaauucaacaagaaaacaaacaacccaauuuaaaaauucauaaaagaucugaacagacaccucaccaaagaggauacacagauggcaaauaagcauaugaaaagaugcucaacaucaugucauuaggaaaaugcaaacuaaaacaagaugacacuacacaccuauuagaauggcuaaaauccaaaacagauacaacaccaaauucuggcaaggauguggaacaacucucauucauugcuguuaggaaugcaaaaugguacaggcucuuuggaagacaguuuggcaguaucuuacaaagcuaaacauaguuuuaccauacaauccagcaauugcacucguagguauuuauccaaaugaguugaaaacuuacauccguacaaaaaccugcacaggaauguuuauagcagcguuauucauaacugccaaaacuuggaagcagcuaaaauguucuucaguaggugaauguauaaacaaauuuugguacaucaauacaauggaauauuauucaucgauaaaaagaaaugagaugucaagccauuaagagacauggaggaaccuuaaaugcauaucacuaagcgaaagaagccaaugugaaaaggcuacauacuauaugauuccaacuauaugacauuaugaaaaaggcaaaacuauaaagacagcaaauagauuaguggguaccagggugggguuauggggaggagggauguguaaguggugcaaagugaauuuuuaaagcauggacacuauucugugugacagaguaaugggggguacaugacauuauacauuuggcaaaacccauagaauugcacaacacaaagagugaacccuaauguaaacuguagacuuaguuaauaauaauauuuuuauauuuguuuaccagcuguaacaaauauaccauauauugcaagauguuaacaguagaggaaacuaagggcagggaggaaguauaugugaacuuucuguacuuucugcucaauuuuuuuguaaacuggaaacuuugcuaaaaaauaaacuauuaauuuucagaaaguggacauuuugagaaagauuggcaagucagcuucucauaucuacuuugacaguugaugguauuuuuguugugcagacuuacuuuaugguuucugcauuucauguccugaaaagucuucucuauguggaucuuuuaaaaaaauuuccauauuuucuuuuaaugagcuuauaguugcauuuuucuuuauuuaaaaaucuuugacuaaucuggauuuuauuucaauuagaagugauccuuauuuguaacacuaucuucuugaaaauacaucauaaaauacaagccauaaaaaaucauuuuaaguuaaauggucuaacacuguuugagucuaaaacccucucuguguugugaugugucuugagaaauggaauaggauucuuaaacugcaguccauuggauuaguuaaugagauuuacaagagggccuggaaauccccaauuugugugugugugugugugugugugugugugugaugcacaugugccugccauacagucauguuaugcauuuuuguuugcaguguucugucacuuuaaucauguucuuagaguguucacaaauccaaagaugauuaagaaauacuagaguugaugaaaacuuuuccucagaauauguaaacucugauaaaauuucccaaaauagugauguuauugccaaccaaauggaauuuuuaccuuuaacgcacuuuaugcacaagaugguugaaauuaacaucagaacaaaacacuucuauuucaucaacuguauuccuuagaaaucauucacaauuaaguucauagagccagauuuaggaaaagaaaacacgcaucuacuggaugacucuauuggucagaaucccuacugauaaagacaguuagauuuugaaauuugcuuugcccaggcauaaagaaauugauucuugguaaaucauggggaaaaaagaaaaguuagaucauaacauagaauucaucaucauacaccaugucuaagccaaaaaaaguaaaccuuaaauuauucauacugaaucaaauuaucauuaaucuaaucuuaauggaaaaguagaaagauuuauuuuggaguaguuauuuauuacauuuuuauagaucaaauuuuuuuucccauggaaaagaguuucuuaauuguaaaaaacaaaaguuguggaaauauuuccauuuucggaacuagggauuauuuuaugccugucucagaguuuguguuuuuuaaaugaaucguugauaugcuuaaggguauaauuuuucucguuaugcugauguuuauguauuuuucuucuuuguuugaaguuaacaugcuaggaaauaccaccauuuuuaaaauauaguacuuuagaauuaacuuuuuaaaugaacaaggaaauaauauuuauuuuguccucuuacauuaucaaccugaaaauaaacuaaugacaaaaaucuuuauuuugaagauuauacguuuauguacaucaaaaaugaauguaauugggauguagauuucaucaaguuuuaugugaaaaaggacucuaucuaucuugauucugucauuauuguaauggugacaucagccuccaucuuuuugacuauauucucuauauauuguuauuuguggauguguauauguauguauguacuguggauagaacuuuucuacguaguuaauauuuaccugaauuuauaaaucacaucuaguaugcuuuuuaaacaauauauauuaguguguuuguuuucuuuucuauugcuuaggaauuuuggagaaauccgauagagagguuguaauggaaaaaccuagagcaaacgaaaccaauauuccuuccgagcaaucacuaccaggaaaagagguaagugaaggaaaaagaaguguuuuauaauucacauauaauaucaucauaugccugugaauccauuaugaaucaagaugucuugaguuuuacccuuugcuacaaaaaaauaauuuuucaauuuuggauugaaaauuggcuuauaaguuuuugaugagaauucacuuuaguggggaugcugucuucauauaaaaucuauuccaugggaggaauagagagauggaacucaagagaucuuuguuauuauccugacucagggccugcacuuagaggaugugggcuauagauaauugucgaauagcgagaaaauggagauuaaaaaggaaaaggaaacaaucaucucaacuggccucauauuuuugauccccauccugugauuguuuggucccaaaaccuguuaccacucugcucugcucuagauuguagagaauuacacuuuccaggcccccuugcuuucggauucugggacgguuuagccaauuaaaggcauugauggaagaccucauggaaggcauugauggagcauaggaguugcagagaaaucagagccuuucuucuccucucucugucuuaaggaacaucucugauaauggcugugacaccuuuaucuccacccugagcccuguucccaccaugcagccuucccugcaugacuucaguucuaccuggcaggucugcuugggcuuuagcuucgacugguagccccaggagcuacucuuccauaacuuagucccuuuucuaaauuccuccagcccuaggggugguugcggccuccugcuccauuaauaucuggccugcuucacaguccauguuugacuucucaaaucuuccaucaugcagguaaccaaaacccuacauuaaaauucuuccuuuugaaaaaucuugagugguuucugcuuuuugaauggacccugacugauacacuagguaaauauuuaaagagacaaaacaacacauaguuuuaacagaguuuucgccuuuaauaaucgggaaaauccuaaguuauauauuaugcuuuaaccaaaaaucaaaaucaguacuaagaaaugagcacuaaauaauagaaauagagauucaacagauuaucuacuucgugcauagaagagaaaaccaugugauucuguuuuuucuuggaacaacuaguaaguguucucuagucuaaauggaauauguaugaugccaaauauuagaugagaagaguagaaguaagcaaacuauauuucauaagaacaaauaaacuauuggagguuugaauaaguaaagguuuucaguuuucuuuucuuuucuuuucuuuucuuuuuugagacauaguaucacucugucacccgugcuggagugcaguggugcaaucucagcucacugcaaucuccgccucccaaguucaagcgauucucuugucucagccucccaaguagcugggauuacaggcgcccaccacaaugcccagcuaauuuuuuauauuuucaguagagaccggguuucaucauguuggccaggcuggucucgaacuccugaccucaggugauccgccugccucggccucccaaagugcugggauuauaggcguaagccaucaugccuggccuucaguuuucuuuuuaagagcagcuguuaauguacuuguuuuucuauauuugaaaagagaauucagauaggccaacauauuauaauuacauguauauuaucaugggcaaagguaacuuucacugcccaaaaaauuuuuaaaaauucaauacagccauggcaauuaaugacauuuuccacuaggacauauuugcuugaaggaauaaaugaaugacuuuaguaaauagacaugcccugauagggaaaacaaaaaucagaauuuuuuuguuugaauuuucauggagguaguuuuauuuuuacauuuuuuucauaaaugugucccaaggaauuacugucauagcacagggcuauaacuaugccacuuccaaguucucuuauaagaaagaagauuauaucaguugagcagauucaguuuuugaugaauuuuuuuuuuuuuuugagauggagucucgcucuguugcccaggcuggagugcaguggugccaucucggcucacugcaaccuccgccucccagguuccagcgauucuccugccucagccuccugaguagcugggacuacaggcacgugccaccacgcccggcuaauuuuuuguauuuuuaguagagaccggguuucaccguguuagccaggauggucuccaucuccugaccucaaguggucugcucgccuuggccucccaaagugcugggauuacuggcaugauuuuugaugaauuuuaugcaaauauaagauaagagagauguguuuuaggcccucugaugcuugagauccaaauaaucuucagaaaguuccguuaaaauuuaguuaugagcguaaugagagcaagagccauguuucugauuauagagucauggaaucauauaauuuuagcucuaaaaaaugaaucaccuuuauuacuuuguacaguauaugugaaaaaauaaauuauugcugaaugaguuguacauauaagaaaauuaggcuuaugaucauaauuucaguaauuuuaaaauaaaagggaccauagaaaucauacaauucaacucuguuguuuuucuagcaaaaaaaccccugagaucaagaaaaauaagugauucagucagggacauggagcucaggguuuucugaaguugggguagguggcacguuacuguaaacaaaguuacauuaaaacagggaaaguugaauccuaagcauagguucagccugcuacccauaaugcuuuugaacuuuagagaauguuaggagaccuggagaaaauauacauucauaaauauauugccuuaugagccauagaccaaaggaaaaaagaaaacaucagccccucaacuguagcucaaccccuucuacucccuuccaaguacccccccaaccaccacaauagaacagugcagauucuuuuaauucuucauucuuggaacaaaaguagugcugcuuaugacuuugcagcuggagagacuaaaauucuaagcaaguaaaaaucuaggaagugcagugguauguuuucucugagaaauuuauuucuuauugcuauuuuuuggcuugucuggaguucugugagugaaaaagaaaugaaaguugaauauuaaaugcugccuuauguugcaauacuuguuaacaauaaacuauaaaaaagacuauaaaaaucuaauuuagacuuuauuaaauauguugaauuuaaagguuguuuuaugugauaaauaguaacuguagcuuucuguucuuguaaagauggcuuuauugaacuauauuuaagagauuaaauuuuuuaaaaaguuuuuuauuaaaucuacugaugaauuaaaaugaaaugucaguauauuacuguguguaaagaaugcacauguuuuuguauauugcuuuauucacuagguaauauuuuuuagguuguaagaauggcuuuuacaguauaucaaagaauauauucaacauguugaaugaaaguaauaauuuuauaucuauaacaauagaaacauuuguugcugaguuaagauuaacaugacuucauauacauugauauuucaggcuaccuuacuagauuuuggcuggagaagugcauuuaaagaagugucucuucccauggcgcacugcguaguaacugcaauugaagguuuuuccacaaaaauucuccaacaggaacagaaugaaaggucuucagcugugagcuaugcuaugaaccuuguaaauguccagcaaguuuggcaagacagccauauguuuccugaggaggaacaaccaaagaaaauuggaaaagcaaguauaugaaauccuuucaaacugcugacuggcaugaugggauuuauuuuaguauaaggcauugcaaaaaggaccuguagaucaaaugguggagucccuuggcaaguacuugguacuugacccaguaccaguuuucuucagugguauccaugggccacugcugcccgaaaggacuuauaccuggugcuaacuuguugcuccaugaaucugaggcaaccaaaaaggggccucugugacuucauggggagcugggaaacccugggaaaaccaccuguuuugauuauacguuugaaugacuccaggaaaauuuaggagguugaaggaagugcugucuuuucuagcuuugggcacuuaaaaaaaucuucauucaccuuaaugagcuuuucaucucauuaguaucagucuuacaucuccauaugugcuuugaaagucacagaacauacugagaaaauaggagguaaauacagucacuuggcauuaaauccagaaugauuucagcaaccuaugauugggauauucuuuuuuuguuuuguuuuguuuuuuugagacgggggccucacucugucgcccaggcuggagugcaggggcgcgaucucggcucacugcaagcuccgccuccuggguucacgccauucuccugccucacccucccgaguagcugggacuaaaggcgcccgcuaccucgcccggcuaauuuuugguauauuuaguaaagacgggguuucaccguguuagucaggauggucucaaucuccgaccuugugauccgcccgccucagccuccugaagugcugggauuacaggcgugagccaccgcgcccggccgauugggauauucuuaaaagaauuuuugacgaugaccuccuuauucugccacagucacucuaagucuccagaacauucccuagguaacuguguugacugauccaauguggagauaggcuuuacuuuuccauucaucacaccucccuucugccauuaaggaagagaagauacauaauaaauugggaaaggcuagacucaucacuucuaaaaguugcugacacccuaccaauaagaagaugcuacaugagacuguuucugauucuucuaaauuauuuaaauugcacugacauuuauauguggcauuuaauuuuuaaaaacccuuuauggcaauuuagcaaaagaaaauuagaauaaguuuaaaaaauaaugcaaacguuaauaugaaggauacauuuucuugauauuauacaauaucaaggauauauuuucugaguccuacuaacuacagauaaagguauugucauguauagcugguucaugaguuuuuccuaaugucugucugguaagcauaagguuugaaaguuauauagagagaagcauuguuuugguauuuccuuauuugacauaaaacauuuaacuuucuacaacugagaaaucgauuauuacaaagcugcgucauuauauuuauguuugaugccaaauucauuauuuaggaauuuggcuccacuguccauaaauuacuuggugcugucagaauacaaauaacucagugccacauuuauuucucccuaguuuuguucugacaucauggaaaaacuugacacaaugcuuccacuggcucuggcaugcagagaugauucuuuucaggaaauuagagcaaacuugguggaggccuguuguaaaguggcaacagcuguccugcagagacugcaagagagagccaaggagguuccuuccaaagcaccccugaaaaacuugcacacauaccucuccacagcgguguaugucuuccagcauuucaagcgauaugauaauuugaugaaggaaaugacuaaaaagugaguguuguuuaaauuaagaugauggccacgcuuaaagaaacguguaaucuuuggauaucacaggaaugaaauuuugguaauaagauuugagaaagagaaaauaauaauuaacaaggugaauuauuuucauuugucuuaacuaggaaauaucaaaaagguggagcaugggauauauuaaacuagauacauagauaguaagauaguacuaucucuaaaggcacacucaaaaacccacgcauuuucugcacccuaacccagcgcaacuauuuuccgcauguuguuauuacaugaauaaacacacccuuucguuuuguaaggugcauuauacugaccacacugaaaaggaaaaauaaacuuguugucucguggagcggacuuagaaaauaaaugcauuguaaucucuucuaaugaucaagguaaacauauuucaggacagccauuuaguaguaaaguauaauauuugaagaggaagcaucuggcagucuaauuuucauguaucuguagucuaaaacugcaguauguuuucuguguagagauaaaaaugaccacaggcauuaauuaucauauggucuuucuuguugcccuuacacugucuagauauaacauggcuucuugcaaaagaaacacguagacuuagcaguccugugugaccccgagaaucuauucuauauucuuuauccagccuuugcaguccguuaguuaugaaagaaagcagugugauauucauagcuaaagauaaaaguagaauaaauuuggcuugauguaggguauaacugugauauuucuuuaauucucauaaguagucagauguugugauucaugcuugaauuuauaaacaaaaugugccagaaaucauuuuauuuaauauuucuguagaauuuuaaaaaacaguuuaugagauaauugauaucuacaaaauuacaauuuuuaaaaauaaagaauguguuugugggacauuugauagcuuuauaaaaguugguucugacaagugcauguuguucucuaguaaaaacaauaaccuaaugccuaaauaaugcacugaucucuaauaacaggcuuacaaagaauacuuucauuuuugaaugauguauugacaauacaguuugucucaaguugaagugcguauuuguagaacagcagauguacguuuucaaagggcuugcaaaacaaagaccagcuuuuuuauuuuuuuuuuuccuuuuuggaaagugaauguggaugcagacuucagcauuaagaggaaaugaaugauugauaucuaauaaucaaaaccauuuguaguacuggagauuguuaucuccuacugcacaggccuuaaaucucugucucuuugaucauucucucugaacagacccauauuccuggugcuuguccaacgauaucaggaauucaucaacacucuacaguuucagguuacgaacuacugcgucagaguuugugcuacaagcauuuuacaggaugcugagagccaccacugggaugacuacaaagcuuuuuaugaggugugaaguuaaguuuacuaucccuccuuuuuacacaaauauguuuuacugcguaccugcuuucuggcuaauuagaaacaugagcuuggcauuacuaauacccgaaggcuguuaggauaauauuuuuaaaauauugaauucauacuuaggaaaaacaguguuuuuaaaaaccugaaauaaauuagacaucagaacucuccuucugcuuaaaaguaaaaauaacuuaauuugagcugcaagguuguagugcagcauaguuggaauauaaugggauacaaugaaaacucaaagagauaacaaugccaaaaugcuacaaccuugcauuuuuuccaaagagaccaauuaguuauggauauccuugcauuuuuucuuguuauacauuuccauauguguuugauaaauaccuuuuauuaagcagcuuuauucuuuauacuuauuuuuuuccuucucaucauauguucuuaugaguaugcuuuaagacccauuugaggccgggugcgguggcucacgccuguaaucccagcacuuuggaaggguaaggcaggcagaucacuugaggucagggguuugagaccagccuggccaacauggugaaaccccaucucuaguagaaauacaaaaaguuagcugggugugguggugcaugccuguaauuacagcuacucaggaggcugaggcaggagaauggcuugaacccgggaggcguagauugcaaugagcugagauccagccacugcacuccagccugggugacagagcuagacuccaucucagaaaaaaaaaaaaagaacagucaucugaucaguuauaguuuaccuauuuucauuuagccauguuuugaaaucccaaauugaagccugaugauucccagugcagccagacccaggaucaauuaaaauuauucaucaucaagcuucauuaguuucccuucaccuaaaucucauugauuaugugcagaccacaauauuugaaauuccuugaaguugauuccagggcagggugaaacauuuauaauaucuuaauaaaagguaaucaggauuuuuaaaaaaauucaacagccaugccuaguuucauuaacuuuuccauuuuacccuuuccucuagauugaaguuuaugauuuucauuuucuugauuguccuaaucacuauagaguauugagaaaaacagaguggaguuuuauucaucagaaucgcuccugucaccucgcaggcacugaagguuccugugguuugauuuaugcccgaguuauuaucauaauaaauguugcuacaacagagaggagcagcuaauaagaagcucucuuaaaggacuuuccacuuuuucuaaggccauuucaucucuccuuuagaggcccuucccagagaguuuuucuuuuugcaagagcauccauauagaguuuuccaaaccugacauacuucaaacagucauggaagcagcaaacagaaugagaaggagaaagugguauggugcagcugguagccugagauaagaauuaaaguauuggucuuccccucuccuggcagcaucauauuuuccuuauuugccuugaaguaaacagagugguugaaaaugaauccaucucauguuucaaacuauuucaguaugucaguguacuacuaaugagcaauuuuauaugauguuuuccgugaagaacagguaucaucucacuauauguucaacauagggguauuauguuuccucuuaugcaaauugggagcuagaagaguuguacaguguaaauaaguggaugcauugagaaccuguuauugaaguuaccaaguauuuuaaaaaccaacaaauuaccauguaacaugcagcucuuagaucuuaugacaaggcuuuagcuucaaagacggaaauaaccagauaguuacccugugauuacaugguacuguagcuuccauauacuuacauggucaguaguuacaauuuaauugcagaguuagugguuguuauuuauucucagaaaaauaaagugauacuuuuuuuguguaucaaaaauaagaaccuucuaaaaauagcacugauuuuaaacuguuuugacaacuggaguaccugacaugguuuuaucuugcuuacugcaccccuuucuucugcucuccccauuauuccaacugcuuugugaaacaggacuaguauguuuuuggcaggccugcuuugagagggaaaaagaugauaucugccugacuggaggugaaggguaggauagagaucucaagggaaccuaucgccaugcgcagagcauaguaaagaaauaguaaaauaauuuacaagauaugcagcaauguuugcucauguuuugugauagcaagugagaucuagauacauuauuuccauuuucuaaacugucagcuugagagagucagaguucuguaucucucugaugaggugcuggucacgauggcacaguggguguucagauuacauguuuaaaauuaagcuuuuaggaugguugacaucugcucaguuuuaggaacuuguguuuuccaauagucaaagaauaaagaauugucuguucaaagauaauauugaguggcuucuauaauaaagcccagcugcuuguuuccugauauauaaucuaaauaaaagcucacaucuguuuacaucauaguggguuugcaaaaauaacagauguuuacuagcagaauacuuuugaaaugacaacaaauaaggaaacaggucagaaaaauaaaugaaccacauuuaguuuaaugaaaacccuugcauacauugaaguuguaugaauuuaaaaagaauuguuagaacaaagaccuguuugaaauauuuuaaaguaaacaugaaguuuauauuuuaaaaagucuuaaaaugaguauuuuuuacuuuuaagggaagaaaucugugugcccaaaguuacuuuuauuuucucauuuaucacuaaaugguagcuguuaaggaaauugguuuuuaacauuuugaagaauaugagaaaucauuuugaucacguuauaauaagaacugacccauugccauagggaaaguuaguguaaaucauucaugcuagucacuaucaacuggggucaguuuugcuuaaauuuauaugcaacacaaaggguaugagagaaccaagcguuaaaacuccuuucuugguuuaaaaaguauucaucaaaacacaugacaaagaaagcauaagaaacuauaauuuugcugcuucaucauuaauuuuguaauuucuuuuaucuuuuuuuuuuuuuuuuuuuuuuuuugagacacagucucgcucugucacccaggcuggagugcaguggcacgaucucggcucaccgcaagcucugccucccggguucacuccauuuuccugccucagccucccaaguagcugggacuacaggcgccugccaccacgcccagcuaauuuuuguauuuuuaguagagaugggguuucuuaguagagacgggguuucuuaguguuagccaugauggucucgaucuccugacgucgugauccgcccaccuaggccuccuaacgugcugggauuacagguguguaauuucuuuuuucuuaaagaguuuagaugcacaucuaauuaggaaaucagaagucaguggccaaaguccccucccauuugaacucgacucugacauuuugaugcccaaguuucuuacccaaggaauacaaauucuacugguuuauaaaugucauuugaaagucgguagauaauaacuauaaauuauuaucguuucauuggcugcagaagauauuaguaaucaaauaaacuaccagaagaguaauacauaaagaaaauacuaaugggagugucuacauaagaaaugaucaacuuuugguauaagagaacagcagauuuuuuuuuuuuacaugacauuugccugacaaauacagauaguagacaaagcagaaauuuuaaguaaaagauaaucacuuggaauauaaugggaaauuuuacugguuuaacuuuugauauauuaacauaaucaagauaaugcuugaggaaugcauucuaaucuuccuauuucaaauaaucauuugaucugauuugaagaaaauaaggugaaacuacuagcauaccucccugagaguacguguuaccugauuaaugcuuguaaaucauuugaggccacacucuucuuucugccuguuccccuuggccuuggccauuguuaauucuuccucugcagucggaaaauuuggcacacagaagagaucuguacagggguggaaaggaaugaaaauauaacucuuuaaaaguaugaagugucauaaaaauacuaagaaaugaugauaauaugugccuaggcuuuagaaaaucuuguaaacucagacuauugugguaucuguuucuaguauuguuauuuaaaugccauaggcaaaauagccuaauguaauaauauucgauaguuacccaucccccuuaguuucaagaauguuccuaagaaugcaguaugcaaguuuauuuuuacuccuguuacuucauuauaaugcgaaaucugaaacauuuauaaaauuaccuuaaugaugcuaauaggcucagaaaaauauaccuacugaaauuauuuaaauagauuuuaauuuuagaagaaucaguccacuaucuuaaacaagcuagcauggcuuuuucagcaacuacaaagcuaguuguuuaaaaauagauuuuaaacccuaggcuaggcguagguaaaucaaggcuaugcuagguuaaauguuugugaucuggauuugcacuagaauaucuagucucgaaauaaaacaucuguuccuuugucaauaaggauguuuuacaucuugucaaaaaucuuuguuggucuucuagugugucaaacucuuuagcuauuuccuuucagccugaacuaauuacguucauaggaagcaaaucgacauuuuagaagauguaacucuaugguuuaacgugugcuggcuuugccagggggaaagauguuccuucucgauccagauguggcauuauuucugcuggucucuucauuacgaucucuggaccauucugccuccuaaguuagcccaggagauucuaguggaagugcuggagaaaucuuugagucuacuggccuccagauacgcucgggcccaccccagccguaaaagaacuccacaguuaagguaauugaaguucugaaaaacauugcuuuucaagaaaacuuuucauuaguugguauaaagcagaauucugaaucucaugacauacuccuuauauauuuaacauguuucuaacaucugaaaagaaaucauauucuauucuccugaguuauuuaaguggaaauaugaaaccugauucaaaauacguuuguucuuuuuauuccuuaaaaucgucuauagaacccacuuguugcuaaaaaaugauucaagguguccuauaaucuaggauauagauacacaaauguuaauaagauaaaaauagaaaauuaagucccugaaauugauaccaaagcauccaugccaugauggagcagucaauuugacacauuugauuugagcuucuaggcaaccaggggauuugaguuguuuuuuguuaaggcuuuaaauauagaagcuuaucuucauuaagaaaaccuaauuauuuucuuccuaauauauucuaauuauuuuuuccuuuuauuuucacuauuuguuacuaacagccaguucaacaaaaugugaaaucacagaaaaugaggagcagcagucacugaguauuaaauaagacugaauucuaguacaauucuaugaguuaucuaggcaaugaauauaugaauugugcuuacaugacuacaguggucuuguauguauaugaagaaaagccuuuuguuuuguaaauauucuguauaaugugauucagaccuuuuagguagaauaaucuuuuuucagauauauuuuaggaggaaccuacagacacgggaggcuuucuuuuuuuuuuuuuuuuuuuuuggcaggaggaaucauuuccugaucauguucuuguaaagcaugcuguaauuugaagggcauuuagguccugcugcaguguuucauaaauaugguauuuugcacaggcuguuuugaauuacugaccagacucuuuuaaaaaacugaacucugaagaauagacggaaaauuccuuuugaaagcaaagaauaccuucauucuuuuccuuauguagcauaaaucacuuuugauuaugaaauggcaagucauuaugagauauuugugaaaucagcuuuacuguuaccucaugaaauaaguagaaauggguaguauauuuaaugaauuaacuguacaauagagacuuuugguuuuuauuuucugggugguugcauaaaaaugccaugcaaugcuagaauuauugcuucuaguuuuuauaaguaaaauauauaaauauuuuuauuugacugguuaauccuaaaccaccauuauuauggaaaucagauuguguaugugugucucuccauauauauuggauuagaaauuguuuaucuagcaauuaggaaaagcauguacaaacuaaaauuaaacguuuauaaaggcuauuauugauucuuuuaguauuccaguagccuccaaaugucacauaacuaagccauauauaugguuuauauaugugucauauauuauuaauauauaauauuuauuauauaauaaauuugagaccaaaaugucauuuuaaaagauccucaaaguuguauuuuucuuaucacuucaaaauuuucauuuucuauuucuucaacccugaauguaaaagacaaauaaaagaagaaacuaacugaggucuguucaauuuaguuagaugccaaaauaauaauuaaagagaucuucgggucccuauuaaaacuugagaaagauggaaacaaagaaauaagucuaugaauaagauaaauaauaugcauauuuuccacaaauuuauuuaauauuaaacauuucugaaacuauaggcuucucgauuugagcuucguuugucauuucuucuuaucucccacuugcugggagaacaugcuaccaaucuuguaacuuuuuuugacagcuuacauaugagugaggagaauuguugugcuaugaaauuuuaaccuaucauacauauacauggauaauagcaaauuuuucuucucaucuaguuucuguuuugcucaguauaauuuccgggaugaucucuugaguuucuugaacagaauccuaauaauguaaaagaaacaguuuuuaaaagcacuccuaaaacucuauuacagagcucaccaucccuaaagauaaugguauugugggucaucuaacaccuagaaacucaaagagugucuuugauacuuucuuuuugguuuagaucucugaaguucugguaucuaacugaauucuucuauucuuacauaugcuuaguacaagagauaugaaugaaagugccuaccaagcagagacauuauuuuguuuaacaugauuuucuuuucuuucuuuccaacagacuugaugucacaacaauuuugauaugcacugagaacauguuauggucaguuuguacaucuguacagaaacuuuugaauccucaucagcauacagaugauaaaauuuuuaaaauucacacucauuguaauaaucuguuuacaacauuagucauuuugacuucaccauuaacagaauuauauaaguaaguaucaaauguauuuuccuuuuagcuauuaugauauaacgugauuaacaaaguuauuuucauaacacuuauggaauuaugugaaguuacaaguagaaaucuucugaagugcauuuuugauacugugaacuaggccauuuuauaaaacuaacaccaaccaacagaguuucauaauucucgaugcaauucagugcccgaaaauguguuauguuucuauuggucaaucccauucagcugauaaaguucuaauacaaucaggaacauuuuuaguuucacuauuuggguuguuuaaaugaucaaauuauauugauggccugguuaucgcagugauuuuuugauacucugugaaaaagaaaacuauauuugagauauaccucaacuagcaauggcaaauggaaauagaaauaauaauuacauuuuuaaaauguggaaauauuuuacuuagcucaacaaauaagauuuagaaaaaucuagaaauguggaauuacuuuugauuucugguuaauucaauucaaaucuguaaugcuauagaggagguuagaauacgucuuauaauaaaauauuaauaccauuuuguuuauauccuccuccaaaauugucacuuuuauuuuuuaacuaaauaauuguaucuucauggguaguaaaaauuucacauaugucuauuucuaaggauaaauuaggucaaguguuucuuugcauaacauucugguaaaagcgacauacaaaucuuaauuuuuaauacauuuugacacauuuguauuagauauucuaagagaauuaacagccuuuauuucagcuucaccuacucugacuuucaauaaacccauuguuuacagaauguuccuucuagcaacccaaguugagagcuacuuuuagaaauggagcauucuuucagaaaggggaagaaacuguaagauaaaucaccauacgguugauacuauguacauaaucguucauaaucguaaaaagcucaagucugaagcccauaauaaauccuaggaaacuaaacugauuuaccauagaugaaaaaauugcugugcucucaguucaaugggucauuucaucuaagaggaaggcccugugaaaaucgggaacaaaguugacaaauuucauggauuggucauggugagcaauauugaauuucaugcuuugucacagaugaauugaaaaauuuuagccccccaaugcauuuguaaaacaaauaaauuauuaucaaagauugcauauuuuaauaauaauguaacauacauucauuauuguuaaccuauggcuuuuugauacauuuuuaacaacuaugcaaguacugaaaucucuaugauuugugcauuagauauugcacuguaaccucauucagcaaauuuaaauugcuaauuucaaucaggauuacagaacauuuuacgcuaagcacugccucugguuuuucuuaauguaaaacauagauaacuauauugcuuugaagcaugaacaaaaaucuagauauacuuuaauucuuuuaaaauauuucucaguucagaaaauuucaaaaguuuuauccauuuauguuuacuuaaaugucaugauuauuuuccuagacuauacaucuaaucuuugaaauauacuuugcuuuguauugacaaaugaaauauacagggcaacauguucuuugccaauuagggaaaaauauauuuguguguugcaagaacucuacugacuuauugagcuuuuuuacacauccaagauaugaaucugucauacuauuagcauauuaaaaaaauugugaaucucacauuaaaaaauuaaaccacauucuuugaggaauuggugaaaaguagcaaucagauguuaauaauauugaauuuuuauaaacuguaucugacauuugucacucuaugugauaugcccuuuuagaaggugacugccuuuauuucaaguaguucugacggauaaacugaacguguuuuccuuucugaacuuagcguaggaccacgaaaucccuggacaggaauacaugauuuuaaagucuuuucaggaagaaugaaaccuguuugcaaaaauauguguucuuuuuuagcucgccuuuauagauuucuguuagaauguuguaaaaggaguacuucaacuuuguucuccagggaaaggaacaugcugaaacagaaaauauucaccauguauuuuccaaagugcuuaucacuuauauuucuuucauaaaggcaguuaaacugcagguucagaagcauauucacauacauguucauacacauccccacacagugguuucauauguugcauuuuggaugaguagacuuuaguuuuaguucauguguagcagguuaaaaauuaauuacuagaauuuuggguaaaugcaauucaguuucaauucaacaaauguugcugccucucuagccccucugauuaaagaaaagggauacaacaaugagcaagauguaauauuugccacaaguaauuuaagaaaagcugaugauauuuuuuauuuuaaauuaaaauaauauugcccuaccuaaaucuauaauaaaaaguagaauuagauaauaaauuucauauguauaucuaaugucuauaucuauauuuacccgaauguuuugauguuuuauaucaaaacuccuaauaguagaaacuuuuugaaagcuggcuauuucaacauuuaauaagauggaagugugggauuucaauacaacuuccaacaagccaugcagaggauagggucaucagaaauauacccgaagguagaucacuaagccaaggaauagcagccucaucuugggguccauuuguugucacucauaaggcuuuuuagucaccaaauuccaaugcucuguuuauaguucuguuucaaacuaauguuaggccuuucgagguuauggccuuacccuuuguuuaaaaagaaacuauuucacugucuuucagaaaauaaaauaggccuuugcuuuuccuaccucaggagugacuggcacaccuuggaaaauaggcagguccccaaaauguuaagcguagaauaugcuuauaugaaauguugagcauauggucauauggcccagcaaugaaaauacuauguccacacaaaaauuugugugggaguguucaaaauguuauguccauacaaaaauuuguguagcagcauuuuucaaaauaacacaaugagaaagcagccaaaugcccaucaacuagugaauggauacauaaaauguggcauauccauacaguggaauauuauucaguaauaaaggggaauaaagugcugauaugugcugccacagagaugaaccucaaaaacaugcuaagugaaaaaaaccagacacaagagcccacacauuguuugauucuauuuauuagaaauguccggaauaggcaaauccauagagacagagaguagaucagugguuaccagaagcugaggggaggagggaauggggagugacagcuaaugaauacaggguuucguuugggaauaaaauauucuaaaauuagauacuuaggagguuaugcagcuccauaaauauaguauaaaccaucuaauuguauacuuuaaguggguaaaucuugugguauaugaauuauacaucucaauaaaguugugaaaaugaauauagacugaauggaaauuuaaacacauuuaaaaugauuuuuuuuuuuuaaaaaaaagguaucuggcagaaugcaaaauuuuccagaaagugaaguuucuugccuuagccauuuuguuuagguucaaugacucccuuuuuccaccuuccuguaaacauuauuuuuaaagggaaaucucauuuuuuaaaaaacgcaaaauuaaacagcuuuauauaucauccuaauaagguuaaaauaccccaaaagagccagucauugaauuuaaagagggcugcucccagaauauucgacuggcugguuccugguguaccccaagguccagucuuucucucucuccaccuaguguccuguucucaaccugcccuuuggcugucuaccacccacaauugcucuucacagauggcccuuaaaacucauccuccuuuuaacuaagcaaggucugguaauaccuuuuauucauccuuucuuuguuuuaccauguauuuaccaugaaucuacuaugggccaguuauucucuaaccucaaauuaucauuugcuaaccucaaagaguuauuuucaucaugagaaauucaaggcacuuaaaaguuacuuaaugacauuuaggcaacaacuuguagucucagguauaaugccgguuuuugaaagugaaguagcuacuuagaauucuguuuaaaaucuugaauuugguauucauagguaguugucugugauucuagggccaucagaaagguucacauguccucacuuaucucaagcuuuucagggcuaucuuagucauucaguuucacacuaauucugccuuuucuaagguuguggucuucucuugguauuauuuacugaacaccuccaauggcccaggcaccauggcaggcacagaugacucaagaagucuaaccugacccuccauucacauagagcuuacauccuugggcuaccuuaauuuagucauggagguuuauuccauuaacaucguauuaugagacccguuucuccuggggagggcagccgaaagcaacacgacacaagagaagcauaaaacccagcuaacucuuuuuagcucaucaguuguucucacuuuugaugugcauugguuuuuaucuccuuucagcaucuggcuacauaagcccaaagagcugaucaguuuuguuaaaggaaaaaggaaugccggcaacauagguguagaucagagaacccagagagagugaaucuaggacagagugcuggcguggucggcacagaggcccuacgaugcuaacgcaaggaaggggcauagcuaguugaggcuggaggaaggacaaaggcaaggaauuuucccaaaugcacucuuuuccccuuaagcaaagucaucuuuacaguguguucauuugggaaugugaagaaauguaccugcuucaaacuuauagacauuuauuuuuaagaaaguauuuaaauuugcuguaucaaaauucuuuuaugucuuguggaaaauauaauccuauggcucauacaauuguauuuuacucuccacuaugaauuauuuagagcauccucucuuuuaacuguauaccaaaacaucauuagagguugucuaauagcuagcucauaauuucauucucccauugaggcuugugagccaauuuucacccuguuauacucucuagaauaaugaaacuaauuugggaucuugcuguggaauuaaaugcucauacagaucucacucccuuugagaccauaaacaucugccauaauaucucuuauagccaaauaaccuuacuauaaccaguaugacugagaaacugucaguggaguaaaacaguuuagguacuggcagaaaugcucagguaaauaccauauugccaaugguuugucaucuaagaaauuuguguacuaaauaaccaugccauuauuuuuagacccuccauuauuuuaucuagucaugagaauaaaacuguagcuaggcaaccauuuagacuaucaggaauuucauguuaguuuugaaauggccauagacuuuuuuaaggacgauuucuaacuguuguuaucucauaaugauaucuuauuuauauugagcacuuauuguguacaaggcacuuugcuaaauccuuuaaauacauuauuacacuuaaucuucauacugacucugugaggugauuuacuauuuuaauucccauuuuacaaaugagaaaacgaaggcuaaauauacugccaccagcauugccuguuaauaaaagcauguuaaggauauaagcccaggcucucuggcuccgguuccugcaugugcccauacacuaccucuauauaaccuuugaugaccuuacccuugugguauggagcagauaaaaaaguaaauggaaagggauuggagguagaguuaaauccuauaaaaacaaaccaaaauuagggcauagaggggggaugagguugugaaaggggauauauuuuagaaaggguagucagagaagacuuagcagagaagcuucagagguagagcaaucuauggagcuacuugaacaugacagagaagucaucuagguaagguauucauucuuagaggaaugaaguggcccucagauaacuagacaaauagggauuuuaugcaaagagaucaaagaagugugagggaaaguaggcagaggcuaugagaaaggcuacaaagauauguauguccgcauucuccagucccuccugaucucucaucaagacuuccaugucuugucccgucauuuucucugagucuuucucuuccuuugagacugccuuucucuccaggccacuugcuguaucucuugucacauuguaccagcacccucccuuuccuagcucucuugcaguggcaugguccuccucauacccucacuuucuugggcuguauccagacucugguacacuuuuagagaauaucacccaccucuccuuuuauaccuuuuggcaauuccacucuuuguccaaccuuggguaacuccuuuuuucauccuuccccacuuggaucaagccccugaucuugccccaucuguuuguuagcagauggccuugucccuguacuucuaagaaaauccacaccaucaugaaugcacuuuaacuucucauuucuguuuuuaauaauuauucuucucuccacucaccucuacauccuuugauuacucucugaucaauaugucucuuuucccaauuaaaguaaaucuuuuuaccugaucucuugauugcauuuaccuccuacuaauggccuuuuaaacauccuuucuaucuugucuuguggcuccuucccccaaacaucuccuauauuaaaaaauguuccuccguuacuauuauguuucccucucaaaacaguuuucauucauugucuacuuuuauaccuaccacucacucagugcacugcaacuggacuucuacccucagcaugcuaagcuaacaacaugggcaggguccuccauacauaccugauugcuaacucaguggauucagucauuuucucuucuuuuggcuucucuaacaccacuuucuccugugucuuggccuacuucucugauuauuccuucuugguuuugcuugaauguuucuuuaaguguggguauguuccagaguuuuaucuuugacgaucuuuacaucuuacguuccuuuuuuuuggcgggggguugggggguagugugaauucacccauugcuauggcuauaccauuauguugaugacuuccacacugauaucuucaaaccagacagcucuuguaugugcuguaucaguaaauccaaauuacuauuggaugccuuggauguacuucggauguccgcagcccccuuaacauaccuaaaacuaagaaaaauacuugcaauguauccuaagcuucuucguuucccuuaauuuucuccuucuaucuucccauucaugccaucaccaacuccaugucauuaggagaugaauauuguucguucugugaauuuaacauguuuuauauuugucuacuacuuacuaucuccugucucuuaccuugguucagugucuuauccucucugaccugucuacugcaauauugccuucauuaucucccucucuccugccugacucuuuccaaccugcucuccucacuacugcuaaaguuauuuuucuagaauguaaaacugcuaguguuaaucccaugcuauacacucuucagugauucuuuacugccaguacuaaguccaaacuccuuagaaaaacauauccugguaccuggucuggcuucugccuacuucucuagcucacauaguggaauacaugggauggaaauauuacagccugacuuugaagccuauuuaaggaauuucuguuuugaucugagauuuagugagaaaaaaagccuuuuaaagaagagaugauauauuaaagucuaaaaaauguccaagucuauuuaauuagaagauguucuauuuagcaagacaaccagggggagagaagggucagauuugaaaaagcaugaggauacaagaagcaagauguggagugaaaagauaaagguggauuuucaaaauggaaaucuguucuggauaucaaaagacacuauugcuccuguacuguauauaaagagagaugguacuaccucaaaaauuccauuucuaaaguauucccagucauuacucuuaacucuguguaggaaaauauaaucuccuguuguuauacauuuguuacuagccaaguuaucugcuaaagauuuuauguaacaaauccuuuuauauugugucaagauuuagaguugaauuugagccaaucuagaaaaauguuacaguaacuguugauagccguagaucagauauucggguuacauuguuuuaauuuugaaaguauaauuauguauuuuacaacuaaauucuucuuuauaagcccucucuagauccuuaggagcauaaaaaauuaauuauaaauucuaauuaauuauuuaauauuuauaaaucacuuuaaagauuaaaaagagguaccaucaugcuaaaauuuuuacauuaaugaagcaaauacuggcauuuauuggauccagguugaagaaaauaacaaugggacauaaaaauacuacucaugggaagcauaaguaauauucauuguacuauucuucaucguuuugucaugacaaauuauauaacaugagauuuuuaaaaauuaaaugauaauaguauuguuacaccuuccccaaguguaaagauuguuuuauagagguucguaaaaauucuaaaucucaacuugugguuuuucaugucuaugcugacuugcccaccuggccccugagccaccuauuaacauaaaucccaagcggaugaaguagcggcauuguccauucuagcacaauaccauuuuguguaaaaaucuuuaacugagccgggcacaguggcucacgccuguaaucccagcacuuugagaggccaaggcggguggauugccugaguucagggguucgagaccagccuggacaacauguugaaaccccaucucuacuaaaauacaaaaaaaaaaaaaaaaaaaaucagccacacguggcagcauaugccuguaaccccagcuacuagggaggcugaagcaggagaaucgcuugacccugggaggcagagguugcagugagccggaaucgcaccacuacacuccagacugggcgacagagcaagacucugucuccaaacaaagaaacaaacaaaaaaaaucauuaacugaauccuaaguaaaaaucaaaaguuauuucaauggucauaguuaaugcuuccuguauauucuaaacuaauuauuuguauuucccuaggacuuuucagcauggccuggaugagucugcuucagauuccuuaaaaucauuuuuuaagcaaccauuauauuggguuucuugcauaucacauuucuacccuucuuuacucaggugagagccucuaaaugccauacuaucuauaauucuaugauuccuuuuaaaauuuaauagaaauuuuuaucaauggauguaaacgaacuuauaucuuacaaaaagaacuuacgacuuuucacaauuggcagguaaguaaagaguauuauuucucuuuucuuagcucaagaaucaaaggcaugggccucauaauuauucuacuagcuuauagcuuucgugauguaauggaaaacuguaaauuuuuggaauuuaguuuuauuuuaaaacuugucuuucuugaucuaugacuggggauuuggcaguucucaagcuaauuaucaaacauagacauguaacuaacucagagccuuagguagaaguugaaagagaaguaacuuuuuaaauuaugaguaggaucuuucacuuuuauuauuuaauuaacagcacuuaaaaacaagaaaaaucauuuaaaguaugaaaugugcuuccagaguaaucugauggcauuuuguggcauuaugugaaauggcaguuugauuucuugcuaaauauaacauuggaaaguaccuuuccuugguaucugagaauaaaaauaucauguacagcuaaaggagauauuguuaauccccauacauucuugauucaucuuggaaauacacuaucagcuauuuuaccaucuaagcugacuauaucucucucuugaggaacaagauugucacccauaaauagagggugugaaaaccucauauacagaaguuuccauagacaaaacaaacuuacacuguuugccuaaugugugccuauuuccauauggguaaugaaaaauccaacauuaaugagacauagaccccaucuucaaggaccucaauguauuguuauuaccucauuuacauggaaaacuuugucuacauuucuaguuaauuacuuauguuugaguccuagaaauagaauagucucaaugcucugucaucuuguguguaaauauaucuugccaucuugcccauaaauauauuuuauuucauuacgaauuaaauagccaacuccuuaauacucauuguugcaaaaguaacaaacgacuggaucucuuacagugugagucaagcaaacaagcugugucauuugaugaguuccuaagucuauaaacauaucuguucuccauguuauuaucacauuugcuuuaaccuauuuuacugcccgcuuuuaucuuauaucuggaaccacuggaguuauucucuuuuaggcauaacucuguaagacuuccacuuccaagcuugcucggaucaacccagcuagaguccuggaaaucagcauggaaaugggcuuaucuuucaaacacuaauucuuauauuaacuucuuucucuuuucuauaucuacagcaagcaaaaaugcacauuucuuuucuuucuguucuguuuagcaaucaaucuccauuauuauccuaacacaaagacuagaacauggggacgacuauucagcucauaguggaaaugaaauuuuaugcaaauucaugagggcaguuuaguaauacguauuaaaaacuuaaaaauauuuuugcccuuuuaucuaacaauucuguuucuaggaaucaacuauaagcaauuaaucagagagguugacaaaguuuuauauaugaagauauccaucggcacauuauuuguaagagaaaaaauggaaauaaauguucuacauuguagcauuaaacaauucaguauggaauaguggcauaauagacuacuguggagugauuaaagggcuggguuuugagaaauaauuacauagagaaauaauugugguagauaaguuagggggaaaauugagauuaguaaugaugaaauuaccaaagccaacucaguuuuuagagugaugaguguguaccagacacaaugcuaagugcuuuacauacauuaucuuuuuaaaaccucauacuaguucuguaagguaaguacucaggugcuucuuuuauggagugcaaagugcuguauaggcagcaacauucuggagagaacaaaacuggaggccaggcucugaacccaggccuguucuauucuaaagcuuaagcucuugacaaccacacccccaccuuucaaagggaagagcaguucaggaugauguuaacagguguacaugaaaaaucauucuacugcacaaauaagauugucaguuauuaauuauguaaggucuuuuuugugauuuaacuuuguagggauucugacgugcuaguauguaguguuuagcucugcuauggucugaauguauccuccaaaauucacuguuggaaauauaauccccaaugcaacuguguugggugguggggucuaauggaaguuauuuauaucauguggguuuuuccaucuuaaauggauuaguauuaccauaaaaagggcuuacaggaauggguucauuuuaucuugcccuucuucugccaugugaggaugcagcaagauggccucaccagaugcuggugccuugaucuuggacuucccagccuccagacugugagaaauaauuuuuucuucuuuguaaauuacccagucuguguuauucuuuuauggcagcacaaaauggacuaagacagucucaaaggagugaucuaguaugcagauuccccaaacuugcugggugagagaacucuuguuuugcagggaauuaacaauuauuggaaggugggacaucauuaggaaguguuaaacuaugcucuacuaccauauuuagagcacaaaaaaaaguacauauagaaaaauaaauauugaaaggauauauaguggugggguuauaguuuuuaucucugggugguaggauugcaagcaauuuuaauuuucaucuacauaguugucuauauuuuccaaaguuuuuauagugauuauaauuuaauuuuauuaauuaugaauacucuuuuuuugagauggaguuucacucugucacccaggcuggaguccaauggcacgaucuuggaucacugcaaccucugccucccagguucaagcgauucuccugccucagccucccaaguagcugggauuacaggcacgugccaccaugcccagcuaauuuuuuguauuuuuaguagagacaggguuucaccauguuggccaggcuggccucaaacuccugaccucaagugauccacccaccuuggccucccaaagugcugggauugcaggcaugacccacugugcccggccugugaauacauuuuuugaaaagcaaaaagaaaaucuauuuucuuugauuucucuuuuauucacauggcuuaaccuguaaccucuauacagaugauuuccagugcugcaucuauagcuuugagugauuaccuauaccccaacgguauauguccagcuguuguuauuucuugaauacccacuuucauucaauacgaugucuucaaaugauccuucuuucccuucuucccuuguccuucaugcagggagucuuuucuauuaggaguaacaguguuguuacaugcuuccaaaauacagucuugaucaugauuuccauguugagccuuuucuuccucuaguccuaguuuauuauuguguuuaguucauuuuucuuccaaaauucucuuagaaucacccuuucucuccaccccauuauaacaaccuuaguccauuuuacuaucauuuaacguguuuaaaagacuguuuucauuauaucucucucucauucagaaaccuguaguagcuucugcuucacccacacugucacuccuggcuuacuuguuggagaguuuucuggcuuauuuccuggagaguuuucucugcuccaguuaagucagucuccucaugugucuuuaagacuuaguuauuccauauuuuuaauauugaauuuguugcuuauucucagcuucaggccuuuguuuaugcaguuuccuuucuuggaauaccuuugguucucuccuuugucuuucuaaauucuccaugcaaguuauguuaggaggacucucacugauauccccccugcccauuaggugucauauuuucaacuaaguccauauaaucugcuuagaaagacaugauccaugugauuuauaauacagugugcucagagcaccguacaaucagaggaacccagggcagcaauaaaagcaauuuuaaaauaacuaaaguuauugauuugcauuuaucagacauuacaauggggauuccuagaccaccauuauaugaccuuaaaaaucucaccuuuccauucauuucccucaccuguaacagcugucugugugagucuuucacccccaaauuauccuucaaaacucuauucuucacuuuagcaacuaaaaugaacuguucaaggaaauacaggaauuggaugaugacaaacaaaaaauauauuaggccuaucuuuugguaaaagggaaggccgagaggagaggugacugaaauaguuaauaucaugaaggaacuuaguaauuuauucaucuauuugcuuacuuauuuguaccugcacauuguuucagaaagaauuuaagucagcuuuuagcaacauuaaauaaacuaagauaauuaauuaaaaguggcugagaaggaaagaaacaaaaaggacaugaaauucaggacacaaauagaauuaaaaauggacaaauagcaguacggaccauaaauuugucuauaaucuuacuagagaaaacuaugaaauggauaaaagcacaauuuuucauauucuccuagaacccugggaauagaguuuagaagaguuuauuuuagggaaaauaaauauauuuucaaagcaguaaguaaaauguacucuauucauuguccuuagcagugguauaggcuaacaacgugaguugauuuagaaaggauaaucaguuucauacuagauuaagcuaagacauaugaaaaauguauuaaucucaagguuaacacagauaccauauugugcauucauagaaauguucaagaaagaaugcuguccuagucaauuauaauauguugcauuauaaugccucuuaucauuuucuaaacuuaccucuucaugugguuuaaaaaagcauuuucaggucuuccuuagcuaaguaggucauaacuguacacugaguccaagaaguauaaucagugugaguaaacaguccauucauuuuaacuacuaauuuucuuuuauggugacaacaugaugcuuugauucauggccaguccauuuugagcuguauauauuucuuuccacugggcuuuuuguuucuacuaugcuucuauucaauguaauccuguuuuguauuuauauacauauauuuuccucccuaaaaauauuaagcuaucuuugguuucauuauauucauauuacaugcuaugugggucuuuccuuuuauuuaguuuagcaagauguguuuaaucauuccuucaauaaaugcauucaaaaaauguucuccauguaaggcauuaugcuaggugucaauggugaagaaagaggcaggcaaugacauuuaagacaaagucccuuuccucauauugucacauguuggugaagaaaucaauuguauuugccugcuugaccacaguauaugauaccauugucuacucccuccaucuugacauauucucuugauuuccuccugagauuuuuacccacuuuugucuucuuucuuuccuguugcugcuuuucuguuuccuuugcagguucauauacuuuaaccuggcaauuaaauauugaacauuguuaguauucuauacuguaaccuuuuuucuugaugaucauaacauucuauguuuccuguacucuuugugugcccccccaaauccauaucauuaauuuuaaucucucuuaagacuacagauccauaauauauggguaccaaccauacaugacuaccuucuugaaauuuacaccuggaaaucauaaagacaucucaaacucaccauaaccaaaucuggacuuaggauauuccccuccgaacauaucuucuucuacuauucccuaucucagcuaaugguacguccauccaauuguagaagccagagacuuagacuuaggaggcaauuggacaccuccuuuuugcucuccuacacaccaaauccauuacuaagucucauuaauuuuaacuucuaauaucuacucuccauaguaccaguuucaccuuagucucaacuaccaucaucucucucuuaacuacuccagugaccacuagcauuuuuccuguguacauguugacuuccauuuauaauauucuccaacuguagcaagaguuuucucaaacccaaaucuauuuucaaaacucacauuuuaucauggcauacuuauggcuuaccuuccaugaauucaccguuauccuuaaauauguacaaaaaacuagcauaggcuacaauagcugcagagauguaacucuuacccacuucucaacccgcuucugauaccugcuacucugugaauucugcuuuccacacauuaacccauuuacauuuucuuucuaugccauguuccuuucugccacaggaucuuugcauaugcuuuucccuuucacuaaaaugucuuucucuuucacauagguaaugccagcuuaucuucaucucucagcucaaaugugacuucugcagggaagccuuuuaucaaccccaaagacuaguuaacuuccuuuuuacuacaacuucuaauagcauuuuuacuuuucuuucaaugaguuuuuauaauuguuacuuuaucuuuauuuguaugaucacuuaaacuauauauguguccuccacuaaauucuauaagaauaaggaauuucugcuuuuugcuuacuguuacgucuccaugguuuagcauauacaaguuaaacaauaaauauuaguugaaugaaugaauaaaaaaauucaaacugguauuguguccccuaagugcuauauuaaaguauuguauugcauaagugcuauauuaaauggugggaacauuugaucugugugguaaggcccaggcaggggaagcaccaucuuaaugaggaggugacuucuaguauccucaggagagaauaucuagggaggaggacaaaaagaguuuuuggucucccaacugcugcugaaaaacugcucugcgggacugaggaaaagagcuuagcgaucuugugcucugaugaggugccaagcauugacauagugccaauagccaguggagaaguaaugagagauuuaaacaccagagaucuuaaauggcuguuccagaguguggauggacaagcaguaugaaaagauuuucagagggaagucagugucuauggaacaguuauuuuaaaaagugaaaaugucaacugaacuagguauuuagcauauggaccuagauaucuuaagguuuaugucuuuucuaucauggcuuaaauauauuacauaauucagaauauagaaaugaagccagcaaugugaugauaggaaacagcuauagguuuucacauugguuugcauacucguugaguuuugugauuuuggaaaguuagccuaggagugauucaguucaguuuccccauauaugaaacaguuuauauuuuggugaggauguugagacauaaauacaauacaaucuuauuaaucuucuugaagacagcauguaguccaacagucuacuuccuccaucuugaaacaucuucuucccuuaacuucugagauacucucaugggagggucaugaggacuccaugagcugaagugccucaguggcauucaucacauaaauacuaaacuaucauucauagcugcuguuaguaaagagcuauauauuucagagaguggcaaguuuuaucaauuaucuaaacauguugaaaggacuuacuucaaguaugauaaaguggaagaaauauugaaccacuuucuuacugggucaggaauguguugcuaggggagacuuuuucugaacucccuguaauaggucaauaucuuauagacagggaccaauaauagucaauggcaccaaggaguuaacuucugcuccucaaaaggauggcugaguuauucaguauuguccaaugucuuagugauucaggugcuagauuagcguugcugccguguaagaugugccuugcuuucucuucaccuucugccauuauuguaaguuuccugaggccuccccagccaugcgaacugugagucaauuaaaccucuuuauaaauuacccagucucagguaguucuuuagagcaaugugaaaacggauuaauacauggggucauugagaaugucuucuauggcccuaaccuuuacaccacugagaucugcuuauucccuauguuagguucccugaauucuaucauugauucuucagggucauagcugguuacaauuuauucauuuauuuaagcuuaaugacaguggacuuagcaggacaggcuacaguacccccugcugcagauauuucugaaucugcaagugauauuuauuauuacauucuucuaccaccuauuccaucuuucccucaugauuggccaucaucucugccgauuuauguuacuugcccaguggggucaccgagaccuucauccuugaaguaaccugaacuccugguuacuacucccuuaucagacuugguuacugaagucuucugaaugugauaauugccagucaugaaagcauugagagaugcccuggugaaucucuugaguuacagauacacuucgcugcucccuuuaugcaguagcaagcccagcuccucaugauaaguaggguuaaucacccucaccagcauaguaauuccuuucuuugccugauagacugcuggcauggagagccaaaaaugaccagauggcagcuauaacuuuagguuuagugggauccuaaauggucccccugguagagguguguauacccccaucccaccccaccauggaaaccagaaccucugcuccuccagagcuuauaguuauugcgauagaaagcacaaauuugccaaguggauuaucacaaucuuuggugggaggggcugcuccuacuuucaccccuugucucucagaucuauguaguuugucuguuggggccacaguaccauauaaugguuguugguuaaaaauaaguaucaagucuugagggacagcauuccagcaccacugagugucauucccaagcugugaauuuuggaguccauuccaauuuucugcuagucuugcagcuucugcaugauauauaaaugguaggaacaauauaccccauggucauguggccugagcaauaaggcuacucauaucccagugugaacccuacugcagagccuucucuuggcccaagccuuaccucacaucaaguuggaagucaggacaguaugauugauacagcuaagauuuuguuuaaacauucuauugcagcaugaguacauaccaaaaaauugaagaaaguaugugagcuaauugaugaauuuucauaaacauaucugaauguagcuaagauuuuucacaaugauuuuauaaaaauaguuuaauaguuucauaaaccaauaaugcuuggaccccauuacuaccuggaauuuaaaaauucuuuaggcaaauuugugccccagaaauacagcacuuauugcaguauaagcugaguacaacccagccaucaauucauccugucuccuaguacaagauuuaugaguucuauaggauuuauaacauuuucccccuuuguauuacgguggaauucaacauguacauauuugauacauacauacguguguguguguguguguguguguauauauauacauauauauauauaaaauuucccuuucugucauuuuuuguaaggcuaaucucacuuucacagcuccaccagcucaaaggcugagggaacauaugcuucuccauaugcccaacacagauuccucaaugcauuuauuacucagagcuuggugauugaagaauguuuguacuauuuuauuuuuccucauagugagucauucuacuguacauuucaaaaucugugauaaguugaaagauccaagaauugagguacaugucaacaaacagcuuuccaucugguaaaugagagauuuuauuuauaaccagguauucagauacagcggcauaaagugacauucaaaugauuuuauuccaugacugaagggcuaaggaaaacaccaaccaccuccaauccauucaccacacugcaaccagaucaggaaacuccuuugccuuaaacucuccaaugggccuaaaauccacaccuugggauauuaaggcucuccacaaucuagcucuuggcuccuucuucagacuaucucucaaagauucccuuuccuuucuacacuucagccaaaugggaucuuucaguucaucaaauggauccuuaaguuagcacucaacucaagcauaauauauagguaggaaauguucaaaacccaagucaauuuuaauauacagcuuacuaccaaguagcauuuuucauccauugaaccccaagggagcaucuagaaucaguguuuaggguuuaggauggaaguaggggcaaccauuguaaggaucuguuuuagauuuuuaguccaaagggcucaucuagugaguucuuccuuuggcaccacauuuggaacuacugcaaaagccagacccagacuaaucugcaaaaguaauucagaacuccugggauguucagaacugauaaacuugauuccucuggcccuagaguuuaguaacacccuucuucucucuuuaccacucacccaaggcaggagguuuccuagcuaacagugccccaccaauugccugaggaguuacuccaauuugagauauguuaucagaguuuuacaugggaagccugaguuggcccaagguugaaacacaagcugauggauuuugugcauaauaaaguuaugagauguuccaaacaccauuccaagccaagggggaggugcuucgagacuuuuucauuuugugucuuugaaucuucucacuuuuguuuaagccagccuuuuggcaaagcauccucaucauuuuuuuucuauaaguuugccuacucauuuaugagcagaaaaaucaaucaguuaacauuuagaaagccuuuaaaugugcuuaguucacuaguagaagcuuugggauauacagccagugucuucacaaaguucgaaucugggugaauugaacagauaaaacuuuaguugaugaaauaauaaagugcugaaauguguaaacuugccacuaugaagagaaauuuuuagggaagacuucacagggauagagaauguuugcugcaaauuaaaggaagaguaggauuaagauaaagaugaaagguuauagggaguuuauugcauggaugguaucuuagcucuggcugcuauaacaaauauaccauagauuggguggcuuaacaaacauuuauuucucaugguucuggaggcugaaagucuaagaugagauacagcacaguugcaugcuagugaaggccuucuuccagguuucccauagcgaacuucuuguauccucaugcagaaagaggucaggcuaacucuccagccucuucuuagaaggacuauaaucccauucauggggucuccacucucaugaacccaguuaucucucaaaguccccaucuccagauacguugggauuaggguuucaacauaugaauuuugaggagggggaacacaaacauuuagcccauugugggugcagccaagguggaccugugcaaaggcagaggcaggaaagaggaugcuaauugguccuaacccuacugccugugcuucagaaagcacugccuacaugcaucaagccuuaccaugcaugcaacagaaucuccuggagaaagauuguugaaacacagauuucugcccugucccccgcuccccgcccccaauccccgccccagaauuucugaugggaugaggcuggagaauuaggaugugauguugaugcugcugguuuggggcccaagcuuugaaaaccauuggucuagacuguguugaucacuggauggcuuaccacacaguaaauugcaucugcuaaugauaaugcugcagauugccucucucagugauaccccuuucucugcauuacuuuccacccugaagcauaugaugcucccauucucaccucuagauugcucaguccaccuucccuucccugugccgcccuauuccuauguccuuaaggcugucaccagauugaguuuaacuauuuccugccuuuuuuguuguuguucuccuuguaaguugauuucccauuuugcaacuguuagccaaucuaaauuuuagguuucuagauuuuagaagggaaaaguaaauaauguuaucaguuccuuugcucuccugcugauucauugguaaaugaaaguggugaugugagagaccugauuucuauuuucuguucaacacugauaauuuuucaagcagaagcguauuugccucggaauucuuucccuuugaugaaaugauuacccaaguagguaacaguuuaauagcagcaguucugauaauugaauguugauguaaggcuuuacauauuaaauaauuagauuacgguugacccuugacagaagcuuugauuuuuuuucaucugcaaucacauuauauagcaaauuacaaacuagugaaacucaucagaacuucuuucaaucaauaaggaaaggaguuaauagcacauaguaggcauugauauauuugguaaauaaacaaaugaaugcauucaaaaaaugcauaaguaauuuuucuucucuccgugaaacaaaaacagacauaguuccaugaaacauaggcauggguauuuuguaucaguuuuaaauuuggcaagguaccaaauguuaguuugcuuuuagcuaguugagauuaaguguaauuccuuccccaggcaacccuaaaguaagcaagcaugaaagcauuuucagaguaaucagggaggaauugacauuuaaaggaguuagcauuacaucuguacuuuaaggcuauuaauuucauagauaaauuaacuucauuacuccaucuuuaucuugcauuuugaaaggacuccaucagcuggaggacugaaagccgagggucaguugaaacugcucuuaucccagccacguuguaacuggaacuugcuucuggaaacccuacugcaucaugauggacuuuuacugagaaucuugcugaagagcucaagugaguauguguaguuauaagaauguccucgaaaaaccuagucauugcucgaguugaauaacauuuuuuuccuaggcaaacauuggaagaaagauguaaaccaauagcauguaucaacauucagcuggguuagcagcagucaaaagcauuaaaucgcuuuaccaaccuauuugaaaaaauuuauuucaaugacucugaaugagagaaaacuauauuuuuauaugacacuguucuaucacaacuaccauuauauagaaauguaucaauacgcaggguuugaaaugccuaaaaaaauuguaggacugcaguuauauuuccaaagcacaaucugaauuagaccuagagagagaaagagagagacagagacagacagagacagaguauuagauuaacacugggaauuucaguguaucacgaagggugcuugugcaacuuacaaacaagcaagauguggccuacagcuauauccguuggagcacagaguaguaaucaucagaaaauucugaauggaaaucgaggaguaguauaagaccauacuucuccuaauuaguuucuuuuuuuccccuuuaaaugcuuuuuaagaaaaugguaaguaauguuaugucaguauaauauuacaucucacugcugucccacuucaucuaggaagagcuuuucaccauuuucacauacuccugugcaucucuccuauuacguaccacaagcgaagccugauuaacuuuaucaauuacuaguuucacuguagguuucccaaaucaaaaucuuucuucuguaguuccccaacaccugaagcacccaagucccuucaccauucaaauaugaucccagaauaguuuucuaaccuuuuccccacuauuucuuugcaacuuacuccuguaacaguuguuguccccaaagccccaagcauguguucacuccacaccuuggcucaccuaucuuuccuacuuaaagaccugccauaaacaacuuggcuuccaccagucugcaaagcccagcugauguuucggagcuuugaaugcucugucuuaacgcuaaucucuugcuccccugaacuucauagugaacuuucgucuuggcuacuuuauuugcccuuagcaugcacugccuuauauuuucauuguguuuauaugugaaugaggcaaaugucaucgggcccuaccagccuguuaguauacaaaugagguucauagccuuuccuuguguaaauagcuucagucauuucugauaaucuuuguuuucucacaucugcucaggaccaguuccccauauucucucccauccaucucaauguuugguucccaaaaggcacuuaggagcagugucucuugugagaauauugcuucucuccuggugcucuccaaacuguaaagccauguggugccaaaggucaucacaacuccucaggccucacuguguuccaggcagaaaggcagagcuugcucccucccaagcccugaaucugauuuuauguccuuagcucccaagcaguacuguuuggaacucaaaucucacaaaguuuaucugaaagcaauuuauuuagcuucaggcuuaaccacucuccuaaagagaaaacucacacuagggaaucuacuuccucacauaaacaacauuuauuguucacuuauuaguuaucaagcacuaugcuaagcauuuuauauguguuaucuaauuugauucucucuauaaucuuauaaaauauauacuauuguuacucucauguuaaacauaaggacuuggcauugaagauaauuauuacuuacccagagauacacauaucugauaaauagcgaguagcucuagauuuuguacccagccagagcuuucuguccccugcccuuccaauacaaauacucaugcaaauuaaacccugaagcggaauagcguaguauugggaagaauuguuaucuguccacucucagcuuggaucaaccaggacaucuugguacacaugcauuuaacuuaccuuuccagcuagguaggcaaggcuguacuguagauuuuuguauuccuccuuaagcuggcacagugcuuuuuacauaaacaguccaguaaacagugcuuggccaaucagugaucaauuagaauauaaaacauggugcuucacuuaaacuuuauagucuaagugcuuuucagacaaagcagcuacaugacaaggauaauaucuaacaaagcugagaguuacuuucaugugaucuuugaaacccacaggcaugguccuauaagagaaauggucuccuacugauagaguuauggagaauagauuguaaaaucaguugagauaaaccuuuugacuauauugagacagccacuaacuauaggaaguacaauuauaguuaugaauauuuaaccauguucucuuacaaaugaauccuacauuuacuuaucaaaaauaauuauguccacauucugguauguauaacaugauguuguuuuaaagaaacuuggaguuaucaaagguaucauacuguacuauuuuuaguucugguucuuauggaguacagcaguguauuuacccaaccugcucaaacacccaucauuuuaaacaaaggcuauuagacuacaugacugcagugauauugucuuguauugaauuuuacuagcuacuucaaauaccauaaggauaaagugacugaauuuacugaucaauugauugaccuacuucuuaaucuccaauagaauucuugucacuuuaaauuagaaacaauauauucauggaaucuuguuaauuauacuaauauagaaauuauuaugcacacagaaauuaauuuguaauauuuuuagauauuuuauuuuuauuugauuuaaagucucaugauauuucagaguaccauuuuguaauuuagaagcuugauuauauuaggaaauauuagcaaagcaaaauuuuagagcaaaauacucugaauuauauauuucaagcaacauaacuaucagcuuuuuaugugggaguuuuaaauaaauaguguguuuuucacuucuuaugcuaauaagcaaccucagcaaagucuuaggauacaaaaucaauguguaaaaauugcuagcauuucuguauaccaacagucaagccaaaagccaaaucaagaauggacuuccauucacaacugccacaaaaugaauaaaauaucuaggaauacagcuaauaauggaagugaaggaccuuuacaacaagaacuacaaaccacugcucagugaaaucagauaugacacaaacaaauggaaaaacauuucaugcucauggaaaggaagaaucaauauugugaaaauggacacacugccgaaauaaauuuauagauacaaugcuauucccauuaagguaccauugacauucuucacagaacuagaaaaaaacuauuuuaauucauauggaaccaaaaaaagagcccggguagccaaggcaauccuaagcaaaaagaacaaagcuggaggcaucaugcuaccagacuucaaacuauacuacagggcuauaguaaccaaaauggcaugguacugguauaagaacagacacgcaaaccaauggaacagaacagagaacccagaaauaagaucgcacaccuacaacugugugaucuucgacaaaucugacaaaagcaauggagaaaggauucccuauuuaauaaaugguucugggagaacuggcuagccauaugcagaaaauugaaaguggaccccuuccuuacacuauauacagaaaucaacuuaaaauauauuaaagacuuaaauguaaaacccaaaaccauaaaaacccuagaagaaaaccuaggcaauaccauucaagcauagauaugggcaaagaugucaugaugaagaugccaaaagcaauugcaacaaaagcaaaaauugacacauggaaucuaauugaacuaaagagauucugcacagcaaaagaagcugucaacagaguaaacagacaaccuauagaaugggaaaaaaauuuugcaaacuaugcauuggaccaaagacuaauauccagcaucuauaaugaacuuaaacaaauuuagaaugaaaaaacaacuaaccagauuaacaagugggcaaaggacaugaacagacacuucucaaaagaagauauacaugcagccaacaguuauaugaaaaaaaaaugcugaacaucacugaucauuagagaaaugcaaaucaaaacuacaaugagauacuaucucacaccagucagaauggcuaucauuaaaaagucagaaaauaacagaugcuggaaagguuguggagaaaaaggagcaauuuucccuguugguggaagcauaaauuaguucaaccauuguggaagacagugcagagauugcucagagaccuagagacagaaauaccauuugacccagcaaucccguuacuggguauauacccaaaggaauauaaauuguucuauuauaaagacacaugcaugcauauguucacugcagcacuauucaaaauagcaaagacaugaaaucaagcuaaaugcccaucaaugauagacuggauaaagaaaaugugguacauauacaccaugaaaugcuaugcagccauaaaaaggaaugagaucaugucuuuugcagggacauggauggagcuagaggcacacugacacaggaacagaaagccaaauaccacauguucucacuuauaaaugugagcuaaacaaugagaacacaugaacacaugcaggaaacaacacacacuggggccuguuggaggguggggggugggaggagggagaggaucaggaaaaauagcuaauggauacuaggcuuaauaccugggugaugaaguaaucuguacaacaaacccccaugacacacauuuaccuauguaacaaguuugcacauccuguacauguaccccugaacugaaaacuuaaaaaaaaagaaaaaaaaauagugguuuuuuuucaucuaauugauaaaacuuaauuuuguguuaaauugucucaggaauaaaaaugcagaaauaugaaguacauguauuuauuacauuuuuuaaaacaagguucucuuuguuuaauaaauaauuguugaauacuguuagguacagaguuuuucuugauaaacaacugcuaugguuugaaugucuccuucaaaccucauguugaaauuuaauugccauuguaacaauguugagagguugaaccuuuuaagagucgauagggcaugaggacucugccuucaugaaugaauuaauaccauuaucaugggaaugauuuaguaauugcucaaggggguuccuaauaaaaaggaugaguuuagcccacuucccuguaucuuguacacuggcuucugccuuccacccuuucaccaugagaugauccucauuagaugcuggcgccaugcucuuggacuucccagccuccaaaacugugagccaaauacacuuguguucuuguuaaauuacccagucugugguauuguguuauagcagcagaaaauggacuaagacaauaaccauguacuauaaagauuaaagcauaugggauuuauugcaucgugaaagugaugucuguagcuuuuuguuucacucuguggaaauuauuucucagaauuuauguuuuucaaaagaaucgacagagccuguaggaaauggcucucuuguaaucucagaugcaacuucacugagcaucagaaaauaacaaaauuaaauaagugaaugguaaggauuuauaauuuaugcuucauaggcugcaaacuuuuaggaaguggaauuauguuuuugccauguaaaauaauccucucuguauaaaauauguagcauuuugaaggaaugauuacauugcuaaaacuuaauaaaaguaaacugauuucacaugguagguggcuuuuaacacugaguacaguucaguuggcaggagaagguaauguuucuugguuuuaaguuaggucaucuuaaaucugcagggaagaaacucucaacuacaaaugaucacagaagauuuuaaaauugugagacacuauuuugaauuauugacuuuugacacccaaggcaauuguucugguaauuaucuugcugaggccacauggccuuacagguuucuuacaugugucaucaaaggaacaaauauuuggcaauuucccaauuguuagcagguaaccuuuccugcuagugacauuugaaugaagugugacuaacauucuuuccuuugccuaucgccccaagaauaauugccaguaaaacuucuugacuucugauaauauuaauuuguaauauaauagcagcagcaaacuaguaaaugcauacuauuuaacauguuccagacauuguuucuaaguaguuuaaauguguuuacuuauugaaaccucguaacagcucugugugguaugauugucauuucccuuuuagagaugaggaaacugaaacacagagaaauccaaguugcacaacuaguaaaugacaaagaaggauuugacccaggcagcuggcuuucaaauucuguuuccauucacacagcaccacauguuccaagcagagccacagaacauuuaccaaauagcaauauugcacaauucaugggaacuaucagaaaccuaaguaguagauaauuuucauaguaccuuuuguacuuuuuaaccucaugacaaagugccuaaagauaacaaagaaaaauaucuagagaaaauucugacuaaaaggcuacuaccauuagcaaguaacuguugccuuaaaaugaaugaaucgccgggcacgguggcucacgccuguaaucccagcacuuugggaggcugaggcuggcggaucacgaggucaggagaucgagaccauccuggcuaacacggugaaaccccaucucuacuaaaaauauaaaaaauuagccaggugugguggcaggcgccuguaguccuagcuacucgggaggcugaggcaggaugucaacccggaagguggagcuugcagugaaccgagauugcgccacugcacuccagccugggcuauggagcgagacuccaucucaaaaaauaaaauaaaauaaaauaaaaugaaugaaucaacuuaaaauuaucuuaccauauaguuaauauuuucuuggucuuucagguaauauaaggcauuuuauggcagaagcuugguguuuuguuguguaugguguguggguauguguguguauuuuccuguuauuguuuuucuuuuaguucuuuauuauuagaaauggggucuugcuauguugcccaggcuggucucaaacuccuggccucaagcaauccucccaccuuugcuucccaaagugcugggauuacagauacccagccauguguuuuguuuugcaagugugaccaaagugcaauuuaauaacugccuugaaggaggugaccuaaaauaacccauuguuagccaacauaacaaugaugucauaggcugcuuuugccaguaaugaugucugcacuacaggacucugacuuguucuauuuuuuuuuugucacuuucuuuacuaagaaccauauuugugugucaccauaugggauccuauccaaagauccuauccaagaaugcugaugaacuaguuuagagguaucagugggcuccauaaaauuauuagucccagaaagaguuaccauuuagauucuuuugagacuucaugagggugagguggggguggugcuucuaggggagguagugggauauggauuauguaaaauaaggcuucuugucuuuaagugcaaacauauuaccuggggaucugguuaaaacuguagauucugauucaguaggucauggguggggccugagauuauggauuauguguuucucuaacaaacucccaggugaugcugcucccgcugcugcugguucccaggcaacuuucucuguagcagggauaucaaacaagguaucugcugcuauagaaggcaaaagaauuugaguauguggcuuguccucguaacauauuguagguuuauaaaaagacaauuuacuuaagaauuauuaugaacuauuaugaauuauuaucaggacauucacaguggucagcaagcauaaucuuauucacauacagaacugauuauguuacucccuugcuaaaaacugauaguggcuacccaaugcuuuuagaguaagagcccuaauccuugcaacaccaacaauccccugcaugcucuagauguggccaacuuguccagcucaucucauccuacucacccccagcauaguaugcuccaacacagggucaugcauucucugguuuagguugugcaucauagauuuguaauuuauaauagcaaacucccugcagaagucacuugaagaaaggggcagcugcucuaauaccagugccuuuucaauugucccauaugccaaguucuuuccugcuacagagccuuugaaauguuguuuuuauuuauuuuuuuaugccuagaccauuucuugucucuguuuaccuggcaucuguuagucaccuuuuagcauaaauguuacuuccuaggaagucaucccugaucauccuggcugggugaggucccacuguacuucuuuuugucacaauuuuaagugaaauguuaauugacguaauugguauuuaaugucuacuucagccacugugaguuuuaggaggggagggauaguucaccauuuuauccccagugccuggccugguucaugacacauuagacugguacugacagcauagaacaugcuuuaaaaaaguauuuguugaaugauugcaggccuguucauuuuauaugacaauucuguuuuauucauugaucucucuaaacucucauuuucucauuucuaaaugggguacuaauauugaccuuauuaauucauuuugagcuuuaaaggguaaauaaacauaaaguacucagugcauugccuggaacauaguagguacuuaacuuauguuagguucucuucauuuuuuuuauacugaaugccuggaaaagaugucugaugcauuuuuuauccucugauuacuccugugcucucuaugcaauggucucugccugugcuucucaguaacccuccccuuccacguaagcauacauuuaaagagucuccugggagaugagguucucauuuuuggacaucuuugugccugagaagguguugccuagcagcugucauguauuugaaggugagagguagaccaaguaaauauucucaaguucuauauauuuaggacuccuugagaaucuuugcauauagcuugggagauuggcaguuugaauuuugcugugauguuucaccugcauugaaucaaaucuaaucuggcuuggcagugacugaaauauuuuauauucuaucuguuccugaaacuuacaaaaugucuaauaugacuguagaaacauacaucuuccuuaguaguuaaugugcuucuagcauuaguauguaaaaugauugggcauuauauuacaaguaauacuauuaugaugaauuucugcagcaucuuuucccaagcaacucaaaugauuuaacauauuauuucauuuaugacccgggauuauuaggaccauuuugcaaaugagaaaaauuagauacagaaaaauugaguaaauugcgcacuugauguuuuaagugguccuugcuagaagagccauuauuucuugaaagucuauuguuuuuaaaugaauucuaaaauaaaaacaagagacuuugugaggaugauuuuuuuugaaauaagaaguaauauucuucugaguuaauuucugaaaauguuuuguuacuugauuuuaugaguaaauucuccauucaacuaauauuuagugagcaucaaguauguaccaggcaguguuuuagacugcaaauaaaaugguaaacaugccgugccaaauugccuucauacauucagagcaccagaucaccuggaucagcaggcugaacugucuacucuuucuguacagagauucuggugcaaggggacccucucuacuauacacccaggcagaucuccaggcuuucagaguauuugcuugcuugguccagcagcaugaguugccccaccccuccugugcagagaucuugcugcaggggguccucucugcuccaugugcaggcagaccuucaggcuuucagagcaccacucaucuggaucaaccagccugacuuaccacccuuccugugcagauucuggugcagggaagccuuucuacuucacgcccaggcagagcuccaggcaucuggagcacccacucuccuagauuacaaguuuaggccauccccauaccuguguagagaacuuggacccgaggugguuucccagcuccaagccgagugacacuucugggcgcuugggggcugcuucauuggauuuucccuuggcacugaugccugugccugacaucggggaaccuguagguggaccugccuggucuggcuccaccuuuuguggccccugccaccccccagggcugaguagggagcucagaccacuguacaucucacgaaucaacccauugccugagguaacagagagccucugcuaguaaacaaggaucaacuauauacccagccacauugaccacagacaguuuuugccuguaagugccaucuaugggcuuguauguugaauuccacagcccaauauaaaaccugccaaaagaagugcauaugucuauagaagcaaagccaaaagacccuacagucacaccccccagaaacaggggaaaagggaaagggaaagaaaaaaaaaacauucuaggaaagaaaaagcaaacauacuaccugcgugaaaauaacuacaaaaauuagaaaugccaacaucuccagaugagaaggaaacagcacaagaauuuuggcacaaugaaaaaucuaaauauagugacaccaccaaaggauugcacuagcucuccagcaauggucuguggccaaaaugaaacucagaaaggacagaagaacgaauugaaagcauggauugcaaggacacucaaugagauccaagacaagauugaaaaucaacacaaagaaacuucuaaagcaauccaggaaauuaagaaagaacaaaauaucuuuaaaaugaauaaaucagagccucuggaauugaaaaucucauuuaaggaauuucaaaguaaaacugaaagcuuuaucaauagacuagaccaauuagaagaaaaaaaucucaaagcuugaagacugguauuuugaacucacucagacaaaaauaaagaaaaaauaauuuuagaaaauaaacaaaaucauuaagaaauaugguacuauguaaagugaccaaguccauuaauuauuggcauccugagagagauggagaaaaaguaaacaaccuggaaaauguacuugagggaauaauucaagaucaccugcaaaauacuauucaaaaugaacaucacuaaguaauauggucaccagacuauccaagaucaaggcuaaagaaaaaaagaucuuaaaugcagcuagaaaaaauggccagaucauguacaaagggaagcccaucaggccaacagcagacuucucagcagaaaccuugugagucaguagagauugcgguccuauuuucagcauucuuaaagaaaagaaauuccaaccaacaauuucauaucccaccaaacuaagcuucacaaacaaaggagaaauaaaaucuuucccagacaagcaagcacuaagggaauuuauuaccaccagagcagccuuacaagagauucuuacaggaguucuaaauauggaaacaaaauaaagauaccuguucccagaaaaacacacauaaauacauagcccacagaaaaugcaaccacacaauagaaacuacaaagcaaccagcaaacaauuucaugauaggaucaaaaccucacaugucaauauuaaccuugaauguaaauggccuaaaugcccccacuuaaaaugcacagaguaacaaguugaauuaaaacacacacacacacacacacacacacacacacacacacacacacacacacaacaagaccuuauccucugcugucuccaagagacccaucucacauguaaugacacccauaggcucaaaguaaaguguuggagaaagauauagcuugcacacagaaaacaaaugagagaagggaucacuauuuuuauaucagauaagauagacuuuaaaucaacaacggcaaaaaagaaagaagggcauuacauaaugacaaagaguucaauugaacaagcacacuuaacuauucuaacuauauacacacucaacauuggagcacccagguucacaaaacacaaaacaagcacccagguucuaaaacaagcuauaggucauaucuagaccuauguuucauaucuagaccuaugaaaagguuuagacagccacacaaaaauagugggggaguucaacaccccacugacagcaugagacauaucaucaaggcagaaaauuaaaauaaaaguuggaaaaaaaauacuuauaccauuuaaaaguugccuuuauaaagcuuauauucuggaggauugauugcugagggcaagguggaaaguacaaaucuuauaaaaaguaguuaaguucagcuacuaauaauaaguaccauaaaguacuuuuuauucuuuuuuuugagacagggucuugcacucucacccaggcuggaauguaguggugcaaucauggcucacugcaaccucaaacucuugggcucaagcaauccuugcacgucagccuccaaaguagcuaggacuucaggugugcaccaucucacauggcuauuuuuagaaaauuuuuuguagagaugggaucuugcuauguugcccaggcuggucuugaacuccuggccuagaacaauccucccuacucgaccucccaaagucccgugauuacaggcaugagccaccaugccuagcaugcuuuucuaaaacagugugacuaguagagauugacaaauugagugauaaaaagacuguuaugaaaagcugacaccuacuuauacuuacauaugguuucagaguagauggaaaauguccuuauuuaguauuagcuauuuggaacauauguacacucuuccaauauucaugaacaggggcuggcaaauuuuuuuuauauacaagacaagauaaaaaauauuuuaggccuuguauaccauacagucuucaucauaauuauugaacugagggaagaaaaaguacuaucuuuucuucaccgauuacaagguucuuggcugacaccacauaacaaaggacagauuaacaagagaacagcauaaaaagguauuuaagauuucuuuuuacuauucuuaccauuuuaauugauacaugauauuuuacauauuuaugggguacaugugaguauuuguuaaugcauagaauguguaaugaucaagucagggaauuugggguguccaucaccuugaguauuuaucauuucauuuauaucauuucuauguguugggaacauuuccagucuucuuacuccuuugaaauauacaauauuauugcuaacuauaaucacccuacucuguugcugaacgcaagaacuuauuucuucuaacuguauguuuguagccaguaacuaaacuuucuucaguagccucugacccgcacgcuauuccaagccucugguuucuaucgguuuauucuuuaccuccaauagaucaaguuuuauagccuccacauaugagugacagcauaugguauuugucuuccugugccuaacuuauuucacguaaaauaaugaccaguuccauccauguugcagccaaugacgugauuuuauuauuuuuauggcucaauaguauuccauuuugcauacauacuauguuuuguuuauccauucauuuuuugauggacacuuagguugaauccauaucuuugcuauuauaaauagugcugcaauaaacuuguaaaugcagcuaucccauugauauacugauuucuuuuccuuuggguagauaucuaguagugggauugcugauucauaugguaguucuggccaggcaugauggaucauaacuauaauccaagcaccuagggagggugaggcgggaggaucgcuugagaccaggaauucaagacuauccugggcaacauagcaagaccuucucucuauaauaauaauaauaauaaugauaauaauaauacaaaaauuauccaggcauaguggcaugagccuguagucccagcuacuuggaaggcugaguugggaggaucacuugagcccagcaggucaaagcuuuagggagucauuucucaaaagaagacauacaaaugaucaacauaugaaaaauguucagcaucacuaauuaucagagaaaugcaaaacaugccaugagcuaucaucuuaccccuguuagaauggcuauuauuaaaaagacaaaaaaauaacaaaugcugugaggaucuggagaaaagggaacacauacacuguuggugggaauguaaaguaguacaaaccacuauguaaaacaauauggagauuucucaaaaaacuaaaaauagaacgaccauauggguuuuguuuugguuugguuuugcuuuguuuuguuuuguugagauggggucucacucuguugccuaggcuagagugcaauggugagguccugcuguguugcccagucuggucuugaaugccuggccgcaagugauccuccuaccuuugccucccaaagcuuuggcauuauagacaugagcuuccaugccuggccuguugagagauuuuaucacaaagggauacuguauuuucuaaucccuuuucuuugucuauugagguaaucauauguuuuucuucuucauucugcugaugugauguaucagguuuauugauuuauguaugcuaaaccauccuugcaucccugggauaaaucccacuugaugaagguguauuauuuuuuuugaugugcuguuggauuugguuugcuagcauuuuauugacaauuuuugcauuuauguucauuagggauauuggucuguaguuuucuuuuuuuguuguguuccucucugguuuugguaucaggguaaugcuggccucauagaaugaguuaagaaacauucccuucuuuuuacucuuuuagaauaguuugaggagaacugguguucucugaaaguuuggcagaauuuggcagugaaacccucuggucuuguacuuuucuuuguugggagauuucgcauugcuccuuucaucucguuacuuguuauuggucuguucagguuuucuguuucuuccugaauuaaucuugguagguuauauguguccaggaauuuauccguuucuuccaggucuuccaauuuguugcuguauagcuauucauaauaaucucugaugaucuuuuuuaucuuucuguggucucaguuguaaugucuucuuuuucguuucugauuuuguucauuuggaucuuuucucuuucuugguuuauuauguuuauauuuucaaaaaauaacuucuucauuuaucauuuguauuuuuaaagucucuuuuucauuuuguucuccucuggucuuuaugauuucuuuccuucagcuaauuuuggguuauguguguucuuguuuuuccaguuccuggaggugcaucauugaguugcuuauuugaaauauuucugcuuuuuucauguaagcacuuauugcuauaaacuuccaucuuaacacugcuuuuguuguaucuuuuagguuuuauuguguuuaaauuuucauuuguuuuaggaauuuuuuuaaauuuucucuuuaauuucuuucuugacccaguggucauucaggacgauguuguuuaauuucuauguauauuuguacaguuuccaaaaguuucuuuuguuauugauaucuaguuuuauuccuuuguuaugauuuucauuuuuaaaaguuuguugagaccuguuuuggcuucuaacauauggucuauccuggagaauguucccugugcugaugagaagaauguguauauuuaauauaaguuuuauaugacacaagagccuuccaaaaugaagacucaauaacacagaauaaaacuguauuuuuuauggacaguuauacagaaguauuauuggacacaggaaguaugaucuaauggcaauaaacugggggaaacuuaguaaggccuguuugcuuagguucauuaucuguguaaaaaaaguuauauuaauugaaaguuuuguaaauaaaugauaggucuuuauauuuacauauauuauuagccuuuuauacaacaaaguucaauguuauuaaacuaauuuuccaauuagauuuuaauuuuauuuuaguuaauuuucacagugaucuaggcugugacauccaaauuuaguguuuccuugaaauaauuuucuugugauacuucacguccuuuuaauuuauuggccugguguuuuaaguuuuaaauccucauuuuacaugguauaauuucuauuuuuauacuuucucucuaauacccagauugaaaaugagucuuucagccuccucccuuuggugagggaugcucauuagugccugguuaauucagagucccugagcucauggcacacucuucuacaacauuguugccaaaaccucuuuagugucucagcaggagcuugucauuaacaacauucuuguagaaaguagaaaguaaaaauuaagcaggcugggaaagccaagugcuaguguaccauguauguguaaaucuuuaguaccaauaaauacagucuccugguggguuggugguugaguuucuugccugaaaccacccuucuuuugaagcacuaacaaguugaaauucuugaaaggaguuuaaaauaaugcaugcaacgaaaagagcccuucaguguuauugagaagacauuuguuuguauaaucuauaaaacauuugauaaagaaggcaaaugaaauucaaaguagcaucuuuacuacuaggauuuuuacugguaaaaucugggucagagaauaugugaccuuaaauauguggcuugccaauacugcuuuccagaauuaagcuuaucccuucaucccuccaaccccccagcuccccacuuaaucacucccuaaaccaccaaaagagccgaaaacuauaggacuuccuugcaguggcagagcuuacccuaauagaccuucacagagaggagaucaggccagaaugcaacccuuugcaguuaggcaaaucccagaagagaaaagcccacugggcuaagacagccauaccuacuuccuuuccccaaacucaacacucagaugagucacuccucuuuuguuagugccgggaaaaugagaaguggggugagaccagaagugugacucacauuaaugggaagaacauauaagaguccagguguggguuagauguugcucuaaugggaaaacacgucuuagguaaaauuauugauugagggaggcaaaguggaugacauuuguuugaacaauggauacuuuaggcagaucuagaacucauugacauucaucucuuucacuacugaaaacuccauaaagacacacugggauaauuuuauauuagaaaaacaaaacaaaugucugguccagaaggcagagggaaagaaaaacgggaguuagaccuuuauuuuguggaaaggguaagggacuauagggaagaaaaacuaauaccuuuccucacccauugcaagguucauggcugaggcaccuaugauaaaagacauuaacuagaaaaaagcauacuaauguauuuaauaucaauuuuacaugacaugggagccuucagaaaggaagaccugaagacacagggaaagcuuucuauuuuauauuuaggugugaugaacagugaacaguggggcagaaguauaauuggacuaagggaguauaauuuaauggccauaaacuggggggaauuuagcaagaucugauuacucacauucuucucugugucccuguguuuucagagaggaggacauuucuuucuuccagcuauauagagggcaccucuggaaugagggucuuaugaccuacuuuagaggaaagucagaauuccgugaaggccugcuucaggguaaaagggcaguaguaggucaaagagaccuuccugcuucugcuauuuucucaaaugccaaggugccauauuuugggguagugcauccuaaaccagaucaggacuaacuuaaagagcagguuaaaagaauuaaacuauagcugagucaucuugaaaggaauaggggaauaucagaaugaaagagagcacaagaagaauaucccaauaguguaagaaauucaaaaccuaaggaaaagcaauguuuauggaugagcaccaccuggcaaaguuguugacuuucacuagguuuccagggcacagaccuuagaaacaucuggaaucugcugaggauuacuguccagccaagccuuauuagaugaugaaugaggucugaaguagaaauuaucuuggaauauuggggaaucauagaaaauuauaagucuggauacauaaggcauuauggaggacuuuaaaaggcagcuagaggaguuuagauugauauauauucuaggaaguauuuugauuaaaacaagaggaaaagaaaaccuaaacuauauuaauaguguuagaaucaaagaagaagggacacauugggggaaaaaaugagcauucaauucauuuugagaaggggaaacgggguagagauauuuauuuuauuacaucuaacaauucagagaaggaauaaauacugcuaaggcauugagccuggaaauaagcauaugauggugaucuagacagaacuagggaacacagcaaugagcauaaaagagaaaggucagagccagagauggauaauuuggaaaguucugcauaaaaagaaucuuucaagucaaaggaaaacagaauugcuaagccagguaaaaagcaguguggcuggaagaaggcuaaggccacuguucugggggagcccccaugaaccaaaugccccuucccgccaccuguuuuuguaaauacaguuuuaguccaacauagccuugauccuucauuuacauauuauauuguuuauaguugcuuuugugcuccaagagaagaguugaguaguuaagacacagaccaaauggcuugcaaaacauaaagugucuggcccuuuauagaaaaaauuugccaaccccagauaaaagaggaagagcuaccagaaaagauaugccaaaaaggaacucugaauccaagaaagcauagcugccaggaagucaagagagacgaggauuucaaaggaguaggugaaaagaaaggauacaguggaugugaggaggaugaggcuuagagaaaaaaaucuuugaacuuuaugacuagcagguaauuaugugucauucagaaauaucaauuucuagauggaccaaaaccuaucacaaaauacucaagagauguauuucuuucucccuuccuuccuucuuuucuuccuuccuuagcauuaaaacauuguuuuaguauuaaaacaaucuauuuuuucugccuuccuuccuucuuuucuucccucuuuaguauuaaaacauuucuuccuucuuuaguacuaaacauuccuucuuuuauuccuucuucaauauuaaacauguagcauugauccaggugccguuggaagauaccugaagacaagaugugcauccgcagaacgucauauaguaaaauaguacuagagauguaacaagacaauauaugugaaaauguagaaugcuauaugaaauuaaagaguuuugcauuaaggcaauacauuaccacauaccauauacauaguuuggacugagugcuuugcauucagugguuauugucaguaaaaugucaaagcaggcuuugagaaauuugggauuguaguguaauucagacagcacaaacauauucuuacuauuuuugugaccuugggacaaguaauuuaauuucucuucauuuuacuuuguucaucuguaaaacugggaaaauuagcacccauuccauagaacuauuccucauauccacccuggcaugugcauuuccguugcaugauuugcagggcuguauauuauucaugcucuguugauugccucgcuucaucucccaucuuccucauggcagucucacuucagccacaucacacugccagcaacugcuugucuucucaauauuucaccaauucuucggucuuccuggaaaguaccccccaccuugaucuugucaugcugauaaauuucuacuccuucuuaaagacuuggcugagacaugaucugcuuuguaacuugucuguguucccugaaaaaauuuaaagcaucauccucugcauuuccacagugccucauacuuauaucacuuagacuuaaguugaucaaauaauuuaucauccuaacugagacacuuuuaaaagugaaagaagaugcuacuaguaauuacaccaggacaacagaccuaaaccaggacugcccaggcaaacucagaugcauggucacucaccuuuuccuuauguugcgguaauaauuauuuacuugucugucaucuucuccccgccaacaaaauauacacauauuugcacaauccuugagccccuggaaggggauggccucagcaccugguacaaugacugacacauaggaagcaguugauuaaucaaucaacuuauugauuaaaucaugaugauuuuauuggaggaaaacacauauagccugaagaaauggcauggaaaaagaaaaggagaugggagggcacauuuacaagcaaauaaacucuacuggguagaacagauguuuggggguuggaacauaauuugggaaaagauuguggaacucuugauccucaaucaggauaaggaauuuuuaacaguggaggaaggggaagguuaaaacaaggaaggacaugaggauaauggauaauuuuauguaagaugaauuggagggagcagaaagaagagggaacugcagagacuauuuggauaaaauauuaaauuaugaaagccuggauuaggaauauuugccauuuuauauuuuaugcuuggggaaauagucgagaccguuuagacugcaaguaacagaaauccaaauuagccugguuuaaucaaagagggaaaauugguuggguguaacaacucaggccuguaauugcaguacuugggaggcugagguagaaggaucacuugaggccaggaguuugagagcagacugagcaacagagcaagaccccaucucuacaauaaaacaaaaaagaauuagcuggguguggugaugcacaccuuagaccuacuugcgaggcuguugguggagaaucacuuaaguccaggaguuuggggcugcaaugagcuauaaucaugccacugaauuccagccugggagacagagugagacccuaucucaaaagaaaauaaaagggggugggagggcugaauuugucagcucagcaagcauaaauauguaggcauugcuggauccagguucucagugucaucucauuaggaaucuucucuccuuuucuuaauucuguuucuuacuauaucagauucauucuuagucaaguucuccccaaaauggcuuucagcaauuuucagccuacuuucuacugggguuaauaaccccaguagaaagagaacacugcuuugucaacaauucuagcaaaaauccuaaagaagguucucauuggauaccugcccauuccugaaccagucacuguugaugcaauauguuauggucugauuggccaggccuugguuaugugcccacuccagaugauagugucggcuucaccugaaccaaauaaucgaagugugggggcaggggugggggaggguugggaggauggaggggugagggacacagauaggagcagggauaccuugcuaaaggaaaacuaacuuguuuugaaaagaaagaaaauggguauuaggaagcaaaaccaauaauguucuccacauaaagucuaugauguuauuucuuaguuugaagauaacagugagcuccuuuagaucaucaaaaucaaaucacaggaaaaaaauuucaagaggaaacauaaaaguaaugauauuccaaaugagcaagaauaaagaaaucuauuuauucugaaaugcuuuagauuuaugcaagauaguuaaaauauaagagcuaaaauauaauuuguuaccuuuaacccaacaaauauguuguuuauuauaauaguacacaucucaugcuuauuauccauagaaaacagaaauuauuauuucaccuuuccauccaaacuauaaaugcaauaguacagaaacuuaugauuacugauuuuugagaaggcuguuauggagccaaaggaggguugaaaaggacaauuaaaauggcccaauuuuuguugaauucuuuauauaguuuuauugaggaaccaauugauaaaacucuucagucugauaugacaaggucuguggauuuaagaaacauucauaaauuuguuuguagaauugauagcauaauucuggaaaaacuaaaaaugugaauuuucccaugguacaauguuaguauuccuaguuguccagauuacaaaaaaauuuuuuuagaaugaaugucuauuauucuuaaauuagaaaaagaaacaaaaaaguuuuccuuaagagaaagaagaauuaugacauugagggaaacuagcguugaccuuugaagugguguuauuguggucuuucucacagguuuuuuugguuguuguuuuuguuuguuuuuuuccauaaauauccaugaauaucucagaaacaacauuggguuggauggaccauuguuuugaaauaaucugguaauucucuuuuuauguaaaucuuauuaaaaaccauuuccacagcauuaugcuaguguacauaguaagaguuuaaucauauucacugauaucuuacuaaaucauuuugauuccuuucaagaacguaccuuucaagaacaaguuuccgacacagaaaauaaccugaaccaaggacccagcuugauggaagccaucuuuaaaauauuguaccauugcaguuuuucuccacaaacauuugcaaacguuuuugugagcuacauggaagaagagcaauuaugggacuuuuuauauaacaucccagguaugagacauuuacuguuuguaaaagaaauguucuauagauacuuauauguaccuuuaaagauguuuagaaguuguauugauacugguuuugcugaaucuguuguuggugaaaguuuaccuuacauuuuuucaguauaaagccuucuguugggaaucauuaauuauugguuccuguaaaauuucauauacuuugggacaagaugcaagggagguggaagggaaaagauuuucuuuuuuuauuaauuagggaauguucuaucauaaaaauuuauuuuaauauuuaucacagauuauguuuugcuauugagcauauaagauauuaguaagaugugaaaaguauuuugugauucuugggugcauuuauucagcaaauuaauggacaauacuauuggucgauuuucuucagauguauaaggcauuuauuauuaugaccauagugugucucucuacaaggcaagcauauccugugauuccuuuggagagaauauauuuuucccaucuguauuguucuucuuccuucagcuagagagaauaauaaaggcagugcagguuguauauuugaacaggaaguuuugauggguugccccacccucuggcaggcguaaaaauucucacauugucuuauccuuaauauucugccuuuaaauuuucauauuuaauaucuugugaaaacaaaggaugaaaacuuagacaaugauuuuuauuauuauccugcuauucaaauagugauuuuuaucauuuacauuuaguuuucaaccuguaagcuuucuuuuauccugcuuuggaaccugaauuuucauaaaauauuuccuaggcuccauauaaaagaucuaacuaguucauaaucaugguuucacuccucccagacuuuuugacuauccuccagauauuacuugaauaucauucuagcuguuuuacagucauuauguuucauuuucucuuggccauuaucccuauaaacuagcaauagauaacuuuauguuaugauuuccaaaguccaaaucugucauuuaaaguuucuguaauaaugaucucuuuuuaaaauguuaucuccuaguugccaugcauucccuuacugcuucuugcuucccaaaggaagggcauauuccuagguaaaaaggcugaauuagaagcuuguuguguuucugauguagucuuuauugaauugaaagaaaaacgaacuugaaaguucugccacccucugcugauuuuaguuguuucuggggaaguaagagcuggauuuucucacaagauuauaaagaaucagugacccucaugcuucaaucacuauuuaucuuucaacuauuagguucuugaaccaucuuugacacucagcacaaaacuauacuuaaaauaaccuagaagauauaaauggauuucaggugcugcuaggcaaaauaaaacuguuucuugcuccuaauuugacaucucuccauguauguagugagcaaacccuccccuacauggucagacaagucucuggaaacagacguuauacauauucacagagccugaauuauaugugaaagcucaaaggggcagaacuucaaaugggugaaacucccuucuccuuuauacaaguuguugcuccauaaacauuaaauauucucuggaaccugauaccugcagugguuaugagggucugaaguuuucucuuuucucucccauuuaagucuuugaaaauaucuuuuuuuuuuucuguuagcaaucaugguuauuuuaaaaacccuaauaagauaauacaagguacuaauucauaacgaaauuaagccuuuuacuaugacuuuuguuuaauuuggaaacauaacauuguuacaaguaauacagcugagacauguaaucauaaucccgcaauauuuacauuuuauuacuaauagaucuaugcuucaguaucuauaauuaaccuacccagauuaacuaaaguacauuauuuuaaaacuucacugcuguaguuuccuccugcuaaaucacugucuaugauuucugcacaguuuacccauaaaacaucacagucuuaucauuuuaggguaaaaggacaaagaugaagugguaucuucaucuuauuguugaguaaacaaaaagcagaaauauuaagagaguugccuaagacuguccaccaauuaaguuggacaagacuuagcacaagaaaccagaucuccucucuccuaaggcagcaguccccaacauuuuuggcaccagggaccaguuuuguggaagacaguuuuuccaccaggagggggauggaugaaaccguuccaccucagaucaucagguauugguuagauucucauaaggagcaaacaaccaagaucccuugcaugugcaguucacaauaggauuugugcuccuaugagaaucuaacaugcuucugauuugacaggaggggaagcucaagcaguaaugcucacccaccugcugcucaccuccugcugugcggcccaguuccuaacaggucacgaaccuguacuggucugcagucuagggguuggggacccuguccuaggccauguuauuucucauuuuuuucuauuagacuaaauuuuuugagacacuacuuuuaugaacauacgaauucaguaaugaauuauacaaucugauuuuauacuuagaauucuaucuaacacauaacucuuuagacuggacauaagcuagggagggaugacaagaaggaaaauacccacuuaagauuacuacaaaagcuauaaguacaacaaauaauuaagucagugaccuaauguggguguuucuaaggccaaugcacucuguaagaaauaaauuugcuaacaaucauuggacaccuauguuuucaaaguagaucaagcauuauucaguuagacaaaugaaaauaucaaagcauacauuaccucagcugguuuuuaagacaaugucagaacaggcuuguaaaugaggcaaauacugucaaaaaugcccaucuaauaugauaguaauauacucaaaaaguauuguuuacuuggcuccucgauaauggcauugggcuuacuuuuguuuucugaaucaguuuucuuaacuuucucccaaccuuugggaaaaaaguuuuccauaaccuagcaaaauuaaggguugagauucaaaguuuccacuuugguuuucuacuccuccucagccucauaaagaccuuuaagaaguguugucuagagagcauauauaugcuauauugucugccuguugccaaaauuaauuuacagugccuuaccuuccuaucagacacagugauugucucuauuaccuacauaaauaccugcgccauaguauagguagauuuuaaauguaagcuuucacauauugaaaggcugucuuuguucuauguuguaacuaaucauguauucugagccuuuugucaccaguuuguuugcaauccaccuuaaaaauguuuuaaaauauauuuauugauugaauacaauaaaauucacucauuucaagugaagaguucaguaaguuugaccaauguauaaaucugugugacaaccacaacgauaaagauauggaacauuuuaugucaucuccaaagguucuuucauucccccuuugccguccauucuccuuucaacucucagccccaggaagacacugaccugcuuuuugucgugauaguuuacuuuugauauucuagaauuucauauaaauagaaaucuauauauucuuuugugucuagcuucuuuugcucagcuuaauguuuuugauaauuuuauauuaugcuuuaucauuaguuuauuucugcucauugcugagcaguauuucacugaguaguacuuuuuuuauccacuuaccaguuggguggacauuuugauuauuucuaguuuuuggcuacgaugaauaaagcugcuaugaauacuaguguauaagucuuugugggacuacagucaucccucaguauaugugaggaauucauuccaggaaccauuccccuucuuaaaaaauccauauacucggccaagcaugguggcucacgccuguaaucccagcacuuugggaggccaaagugggagaucaucugcggucgagaguuugagaccagcuugaccaacauggagaaaccucguuucuacuaaaaauacaaaauuagcugggcaugguggcaugugccugcaaucccagcuacucaggaggcugaggcaggagaaucacuugaacccgggagguggagguugcagugagccaagacgccauugcaccccagccugggcaaugagugaaacuucaucucaaaaaaaaaaaaaaaaauccauguacucaacauauacucaaguccugcagucagccccacagaaccugcauauaugcagguuuugcauccugcaaauauuguauuuucaauccacauuugauugaaaaagucugcauguaagucgaccugugcaguucaaacccauguuguucaagggucaacuauguauguuuucauuucucuucaguaaguacuuagaaguggaaaugcuaggugauaugauaaguaaauuuuuaacuucauaagaaacuacuggccgggcgugguggcucacaccuguaaucccagcacuuugggaggccgagguggguggaucaccaggucaggagaucgagaccauccuggccaacauggugaaaccccgucucuacuaaaaauacaaaaauuagcugggugugguggcgcgugccuguaaucccagcuacucgggagccugaggcaugagaagcacuugaacccaggagguggagcuugcagugagucgagaucacaccacugcauuccagccuggcaauggagugacacucugccucaaaaagaaagaaaaaaagaaacuacuaaacuguuucacgaaguagucagaucuuuuuacauuuuggccaaugaugugugaaaauuuuguuugcuccauauucuugucaacacuugagauugucuuuuugauuuugguuauucuaagggguagguaguauuaucucaugaagcuuuaauuuacauuuccuucaugaauaaugacauugaacaccucuucauguucuuagugaccauuugaaaauauucuuuuguaaaauaucuauucaaaacuuuuguccacuuauuaauugguugucuuacugaguuguaaaggguucuuuauauauauugcacauaaauucuuuguuuuauacauauauugauaaaauuuccucccugucuauggcuuacuuuuucauuuucuuaacaaggucuuuugauggagugagguuuauaauuuugaugaguccaguuuaucaguuuuuuuuuuuuugagacgaagucucacacuguugcccaggcuggugugcagucgggcaaucuuggcucacugcagccuccaucucccagguucaagcgauucuccugccucagccucccaaguagcugggacuacaggcacgagccaccacgccuggauaauuuuuguauuuuuaguagaaguggggucucacuauguuggccaggcuggucucgaacuccugaauucaugaucugccugccucagccucccaaagugcugggauuacaggcgugagccaccacgccuggcccaguuuaucaguuuuuuaaccauagugcuuuuuguguccuaagaacaacuggauuaucuaaauuuuacuaauauuucucccauuauuucuuuuggcaauuuuauaguuuuagucauguuuaguucuaugauggauuuuuguguauagugagauaaauguugagguucuuauuuuuccauauggcuauguaauuuucccagaaccauuuuuuaaaaaggcuauucuuuauaaauugaauuacuccaaugcuuuugucagaaaucaauugaccaagugaucaaauagaugcaucuauuucuggacucucuauuuugauacuuggcacuauagguuuauauuguuacuugcuuucuauuuguuguucuaucuaaucuucauuuucccucuauuuuggcccucuuuuggaugaguugaguauuugucaguauuccauuuuaccuuuucuaauggcuucuuuauuuacuguaguaguugcuccaggguuuacaauauguaucuuuaacccaucacaguuuacuuuuuaauaacauuauaccacuuugcaucugauauaagaaccuuaugaugcuauauuuccauuuacuuccucccuauccuuuauucuauuguugucauacauuuuauuucuauaaguauuauaaacccuacaauuuauuguuuuauuuuugcuccaaauauuauauuuuaaagaaauuaaaaaugggaaaaagucuuuuauauuuguccauauauuuaucauuuccauacccuucuuuguguagaucugaguuuccaauagguauuguuuuccuucuaccugaaguacuuccuuuaacauuucuuguauuacaaaucucuggcauuaauuuauuuuagcuuuugauugcgugacaaaaaguauuuugccuucauguuugaaauauuuuucgguagauauggaauucuagguucagaauuuuuuuguucuuuuucguuuuuccuuuagcacuguaaagauguucauuuuauuaucuucuggcuugcauuauuucugacaauaaaucaguggaaauauuuacaguaucuguuuccuuuuauguaauaugucuucuuuuauaguugauaaggacuuuucucuuugucacugcuuuucagcaauuugauuaugaugugccuuguuuugguuuucuuuguauuuuuuucugccuaggguuuauugagcugcuuggaccugagauguuuaauuuucaucaaauuugaaaacuuuucagccauucuuucuuggaauauuuugucuuuugccagccccacuucacucccccucccacuuuuucugggacucaauuucguguauauuacaccucuuggcauugucccguaggucagugaggcuguauucuucuuccuuguuuuuuuguauuguuuuuguuuuuuaaccuucuuucugucuguucuuuuguuuggauacuuucuauugcaucuucaaguucagugauuuuuuuuuuuuuuucugcagugucuaaaguacuauuaagacuauauggugaauuuuuauuacagguauccuuaacuucuggcaauucuguauaguuucuuuuuauauuuuguguauaccuucucauuuaaauauucuuauacauauaugauguuuuaaaaccuuguuugcucguuccaucaucucuuucauuucuggguauauuucuauugacuuaguuuucuuuugauuauggaucauauuucuuucccugucugguaauuuuuuaguggaugccagacauuaucaguauuauguuauugagucucuagauuuuguuuucuuccauuacagauuuuguuguauuguguuacuuguguaucaccuugaucaucuugagaguuaguuguuuucaagcuuuauuagggcagaucuaaaguagucuuuauucuaggccugguuuagcccauuuacugaaacauuaccuuuuuagguguccuuugaaugucagauauacaaugacaucuugccacucuggucugaacuuagacuuugccaaucuuguaugaacucugauaacuguucagcuaacaguuucucaauaguuguuuuuugcuuggcuucuuagagucagccuuuccacugccagucuaguauucuguguaagacugaaaggaaacuuuaugcagauuucuggagcucuuucccuauguagauccgucucuuugguacuucucucagaaaauuccagcugccucauccuccucugacucuucaucucagugagacuuucaugguuugcuugacuuucugcuccuuggacugggauccugaaaguacauucagacuuuaauuuguuuucuuuuaaaggcaauuacaguguuuccuguugucuaauaugugaaaauaguuauuuugcauauauuucccuauuuucuagcuuucauggcaggagagugagucugggaccaguuacuuuaucaucacuaaaauaaaaguucuuccucaaaguuauaaucauuuuuaaaaauaacuuaugauuaucucagguaacaagcccacuagacacauaauaaaauauuuggaauuggcuuuaucagcugacuacugacugaaaacacuaauuuccuaaauaacaucccuaaaagugaaggacucucaguguacuauuuuuuacuuaauucauaauaucauuuucuuggccacuaauauauucauaccaugaaucuguaguucauuugaggauaacuuauuugcuauauagcuacuuucaggaacaacugaacauguuauaugauauuugcuaugcuaaguaaccaaauuaucucagccauucauaauuauuuugcacaauugugcuuuaaaaagaaaugaacaaauuacaagaaaaauucacaccagaaauugauuuuuuaaauaguuuuaagguauuuucauaguguacguucuucucuucuucuauacauuaaugcagugcucuauggugaaaaauguuuuacauugaauuccuguucaugccucuuuucuuccucuaguucuuucccaccacaagauucacucugggccaggcgugguggcucaugccuguaaucccaacacuuuagcaggccaaggugggcagaucaccugagguugggaguucaagaccagucuggccaacauggugaaaccccgucucuacuaaaaauacacacacacacacacacacacacacacacaaauuagcugagugugguggugggugccuguaaucccagcuacucggguggcugaggcagaauugcuugaacccaggaggcagaaguuacagugagccaagaucgcaccauugcauuccagccugggcaacaagagcgagacucugucucaaaaauaaguaaauaaauaaaauaaaauaaaauaaaauuuaaaaaaggauucacucugauugcacaaaagcucuauguuggaaaucccacccaguccugccuuuucacugcuggaauuuauacuccaaaauuaucucucccuuucuucucacuaucaaaaggucuugguguccugcucccaucuagucccaaaggaaaaccuuuaaaccacuuaaacuagaaguuggcaaaccauugccuuuggaccaaauccaacccaccauuuuaauaaaguuuuauuggaaauugcccuguuuauucacuuacguauuauuuguggauacuuuugugcuuccacaguaaagaugaguaguugcaacaaagaucaucugucauacggcuuaaaauauuuauuauguggcuauuuacagaaaaagucuucugaccccugcucuaauuaaaucauauuaugauaucagugacaaauguuuguguguguccuuuuagaggcaauugcauuuuuauaacaaauguacugagauauaauuuauauaccauaaauuucauccuuuuaaaguguaaaaauaucacaguucagugguuuuuaguagauucacagaacugugcaaccaucagcaccauuuaauuuuagaccauuuuaaucacgccaaaaagaaacccuguacccauuaacaguuccuccccaguuccugacaaccacuaaucuacuuucugucucuauauuuugccuuuucuggaacuucuguauaaauggaaucaugcaguaugugcauuuuguguccgguuucuuucacuuaguacaauauuuucaagguuaauccauguuguagcauguaucagaacuccauuucuuuuuauuguuaauaguccauuauauggaaauauacauuuugcuuauugauucaucaguugaugggaauuuguguuguuuccacuuuuuggcuguuaugaaugaugcugguaugaacauuagcguacaaguuuuugugugaauguuuaaaaaaucuucuucuggauauauaacuaggaguagaauuguuguaaacugccagagaauugaaggcgugucccagcacacacacaguuugcaacucugccuucgccuuuuacauccugcuugcacagagccuccagauuagucagaggugagagauuagcgcuuucucagggcuuucuugguaugugcacaguccuguacaugucuguguccuucuucauccccaggaguauggcagagauauucaaaauuccuccccacuguguacauguacauuucauuucucaguuuuucuuuucuuuuauuucuuuuucuauuagcuucuuguuugcagcaaccaguaucacuaccuuaggcagccacagagcuaaaccauugcuacugacuguuuugacgaaacauccuggggauaggacauuuucagucacugaguuaauuugaauauggauaugcauugugaacagugcucuuccagggagauuccagacaagacaaaucaugacaaucugggaaacugggacguuguguauaggucaaaagacauucuaccucuuccagugggugcugggcuuuuauaacuaccauggcuucaaggcugcucguuuucaaggccauaguagaacuugcugaggaaugggagcugggaauagagcagguuaaaaugccacaaagcucacuguuuuuaccaagauucagcugauuuucuugaauaaauucuccuuggauuguugcaagccugugguuaauuuccagaguucucaaaaguugauuuucacaauuuuugccaguguucugauagcuuuaauggaggugcagauuuucccaggucuucacaccaucauucuggaagugcuucuccacacuugucuauuuuuaaagaaugccugaggaggccaaugccuucauuaaaauuaauggcuuucuaauucuaaaauuuuaagaaauuuggaucuaaagccagagauacuggagaauucauauauuacuacauagacuauggacaauucuagauauauguaaaauuuucucuaauucuagugcauugcagagcaguuacagaagauggaggguugaucucagauaagaauagggcagguuaaagugccccaacacuuuuuauagaggacuguuuaaauacagcgguaggccaggcucaguggcucacgccuguaaucccagcacuuugggaggcccagguggguggaucacaaggucaggagauugagaccauccuugccaacaaggugaaaccccaucucuacuaaacauacaaaaauuagccaggcgugguggcgcaugccuguaaucccagcuacucaggaggcugaggcaggagaaucgcuugaaccugggacgcggagguugcagugagccaagaucaugccacugaacuccagccuggugacagagcuagacuccaucucaaaaaaaaauaaaaauaaaaauaaauaaauaaauaacagcaguaaaaguagaaaagggagagucagaagcuugggugcuaacuuagaugcuacauuuauuaggaguggauggguauggcauguacuuagagauuguggauugcuccaagccaucccgucuaguccuguguauaccacugcuugaacuggcuaacuagagaauacaucguugccguacuacuuacugucuguucuaucacuuccuauuugguuuaucuguguccuuaucuucaaaaagugagaaaauuagaccagagcuugucuagauuaaauuuuuacauuucuaacagcuaaaguuaugaagcaucaaagaaacuaauuuucuaaagcaggaaaguaugcuaauguauuugaagaagauuuucaaugauguuuuguuacuuuugacuccccaguuacuuacaauuuaucuggagaccuuguuuccaaugacuucugguugguaaauauauuaauagaauaauuauuuaaaccaaaccuuuuuacuuagaaacauauucagauguaauuuccauugcuuuuauaaagccacauuagguuauucuuuauugcauauaacaucuuucuuaacaguagccugaaaaacucccaguaaauuaccuuuguucugauucuuccaaauuauagaaauuuuaacauaaaaguaacgaaguuucuuuuuggaaaucucgccacaucuguuauuaccaaaauauaaaagauuauacugauaaaaauugguaagcaauuaguagcuuagugaacauacaaaaacugguuuaaaucauucuuaggauugcugcucauagccuaaagcacauucucaauuuaggacccucacugagccccuuucuaaggccuccugauuacuguguuguaaaaggaaguagagucacaguucuuuucaacuuugugugugcucagcugugaaguauuuguuauuuucuucuuaggagucuuaaauacagucguggaaggugaaaacuaacaaagaccauaaauaucaucuuguccagcccuugucacccucuccccucaccauuuuauaaaugaggacaccgaagccccuccuaaagugucuauauuuuuaaugguaauuuuugaaacacuugaaaauuaauuagauaaugaugcagguauucuuuaaguuguaugauucuaaccuuuguuuucauuuguuaauuuaauaugaaaaauggaaauaaacuacaauaauaaaaaucauuaauaaaaauuauuaucauuugaaauaauccuuucccuugcuucucucacuuaugcugauaaugaagaauuaauauuuuggguuuuuagcagcuggguuuuagggcuguuacucuauucuuccuaugcuaugugucuuggcaaucuaggaaccggcucuaacauuuugcugauaaggaaacucuugguaagauucuaacacugaguuaauugaccauuuguaaagaaagaaggaagaaaggaaagaaggaaagaagaaaaaaggaaggaaaaaauauaacugaaauuccauccgucauugauaaucaccauuaauauuauagaguacagcuuuuaauuauuuuauauauguguggagauacauauuuuuaauaaaaauaggauaucauacucuuuucuaaccuacuuuaauuuuuacuacacaauauauggcuuuauuguauagacagaaauaccagagcuaauuaaacaaaucaccuacuauuggacauuuugauugauuuuuauuuuuucuuauauccuuugcauauuuauaauuaauuucuuaggaaaaguccuauagaaaugaauaugugagucaacugauaaguaaaauguugaagcuuugacauuauugccaaguugucaucuaagaaggucauacaauuuauguucucaccagaagaguccaaaacuaccaguaaauauuauguacuguuaucuuaauugccauucauuuuauuacaaagaagaagaaucuuuuuaaaaaauguuuuauggggugguuaucaaucauaugauuucuugguuaagagcagcucuccuuuccuauagcuuuaaacuagaugauuacaaaacugaauucuaguugagcaaggcacaacugauuugcuagguucugcuaaccauaauaugccaucugauuuuaaagucucaacgugcguggaguacgagcuagaggucauccgaugcuugagacuggcacugaccgaugccaucaaggacacuguacagcagauaguaucuguaaugaguucuaggagaaacugugagacaaaccuaaacaagcacauuguuccugauuguuugcuugagagcaugccaaaggaauggaauuauaguccaaaagaaacuaacaggaaagaaucaugcaaaaguaaguacacuuguuucucuuuaagaaaauacaccugaagaagcaauuuucuaggguauguaaucaaguaaaauucuaaaauuuauaagaaugaugaacuauauuaaucuuccuuccauuaaguagaugugcgacccuuauuuuuauuuuuacuaugaaccacaugaucaaggaaacuaaaauggaaaauuauucaaauggucauagucuuuauuuaauuaccaguucaggauuuucugugauauuuuguguucaggcuaauagucacagauuggugacaugauuuugacuaauuuucucaaaauuuguugaguaacuuaaaauccauacucuagagaaauuugcucugauauuccauuuaauuauuuuuuccuuuaaguuuuuucccugcaaacacuaauuauuaccuucuuuucucuuguuaaaacaccuacauauguagcuuuuaggucaaaaauagcacccaguuugguaaguacauguauuuuucugacaggguauuuuuuccuccggugauucugguucuaaauugagugcauuguuccuauucagaacagcgcauccaccaaguguacuuaagaacuaucaguuaccuacauuauucguuuauuuuauuagucaaguccucucuucuuaaauaguuucucccuaucuagaucuuuccacuuuuccagaauuucacaagauuccuuuguauguauauuacguaccuguauucgugaaucuuuugauuauuuaaaauaaaacuuuuuucuuucauauucauccuuaaagaagaauauuuucacuaacucuaaggaaacuuucucuaguuuuucuagagaaacuagaaaacuaggaaacuagagaaaguuuccuuagaguuagugaaaauauuuuuucucuaacucuaaggaaacuuucaacaauaaaauacuccagccgcacucacuaaagucaauugaagggacuagccuuucuuucauucuucuccauggagauccuaaauauugugaccuuauauuacaaacucaaaucaauuaucuaucugugaccuuucauaguaaugcuuuaauucuguccaagcccuauuaaacucccuuugaaucuaguaaagccauuuaauugaaauuggaaaaugucaccuuuucauuacuuaaguucuuucuuuucuaagaguuguugccaucucuccuuuguucuagcuuuuggauauuugauauguuuugagcaauucaguaggcaugauuuauaguuaacauaucaugccauaugaguagcacuauuuugcuuguggcuuucgagucauucuauucacgaacaauuuugcuuuuucuaagcacuuuggaauuccuccauaccauugcaaagagccucuuauuucaaaaaaugcuuacuuauagauaccaguuguuaaaguuuuccuuacuaaauaacauuuuucauaaaaugcucauuccgaguaaaaguacaacauaaagacaaccaugaaggaaugucagaucccaugaauauguaaaagaaagugauggaagaaagugacuuuauaaaccauuuuuugcguucuaagaggauaugacaauaggcgaaugccauuguucuucuuuacugcccucugaaaugcuacagggacuuuuagauuggcacuucuaaaauuuuauuuucacuacagaauauaagauagagaauguguacaugcuggacauuaagucauuuauuaauuucauuauucauucaguagaaauuuacuaagugagagacuacuauauaccaggcacuguguuucagagcagagauaaaccuaaguacaguaucuccuccuggugccaggagacuaguauaacuguuucaaaauggguacaaauaagagauguacaauuuuuugguguaugagaagagacaaagaaauuaaacuucacuaaaaucucacaugggauugucacuggagaccuuucuuggucugugagugagccaguguguguugaggacaguaugugaggaagcuugagggaagagcaggggugccaugcucuuggggagaggccaugagcaggguguccuuauuccuucuuuagcuuucagcacacaguaaugaauuagaguuguccuuuguauuacagacucugguuguaacaaaauuaauccucauaauacauacaagugacuuuaacauauuccuauaaaccaauaagucaacuacaguuuaaaacuagugcugggaaugcaaucaagagcaaacagugacaaagugaaaaagcucccacuuguuucuauucuuaauaugagcucuucacagccauauuauaaaacaaugaugauuuuaucaccuuuggcaaaaaaaaaaaagaauuguggggaaacuaucugaaauguggcuucccauauauuuuguugauguaaaucccuccuaagccaguauugagccuuaagauauuagcuaguuuggagucaucuugauaaacaaaagauuucuacacuaaguauccaaaacaugaagauaaacuucuguaauuuuuuucaacaauguuuuaauuuagugauauauaaucaugguucuuacaaaauuuaucuaacuaauuauaaauguuuaaaggucuuuaaaaaaaaaucuaacuuacuaaaagacaaauagucauuaccuuagggaauauuuguccuucuugacacaguaaaaaugacagaacauggaaaacacuauggugacaaacuaaaaugcauuucuucauuucuuuaucagcaaauacugugacauuaaaaaacacugaagauuuaaagaaauaaauauuacaauaaagauuacaguguggauuuacuggagaguuggauggaaguuaggauggcucugacauagcucugcuuuuagauauuuguuucauuauguuucaaagaacaaauauacaaagaacuaguuguuuuguuuuguuucuuugacaaaaauuaaaugaaagauauaccugagaagauauuuucucaacaguaaauuacuuuuuuaaugaaaauaauccuuuauggcaaaacuuuuggaguaauugucuuaauggaaacaaugaauucuagagagaggaaacagaaauagcaagcagcauuuaggaaaauguguccaugccauuggucacaugcagaaacagcauguugagaaagaaauugaugacagaaauacacaaagugcuguaagaagucauuaguauaguguauaaaaaccaggccuauuuguuucauaagaaccaguguuaccuacaaaaguaucauaucuuuucacuuaagaauuuagaaauaggauuuucuaacaugauguaaaauauugcaaauggaaaguuucagugacucuugaaugcuuuucuuaaaaauauaaaaauaaaauauuuuuccauucguuugcaagaacaacauauuuacaucacagaugauggauauuuguuagucaaauuucaacaacagccuucaccuauucgguaguuaacacugaaaaauaaaugccaugauuuugugggcacagcuaaggauauacugguuucauguugaucuauauguguuuguguaguggcuuuuucaccugugacagccaugaaaaccugaucuugaaacaaacugaacuuagaacuugaccuuuguauugugaaguguuaagcucagauuuaaaaaauaauaaaaaauuacauuauccucauucaacaaauuguuauugaucuuuuuuaccauuaauaaauaaaauuuuaaaaauuaauuuugacauuuucuuuaccuccuuuauuguaaauuuccuuuuugcauguuuuaucaaccacaaauauauuauuacaguaguacauuacagaaaagaagaaaugacaaauacaucaauauacauauauugccuucauccuaagacauagauuuucuucauacuuuaucagcucuaaaauuggaugacacaauauguuacauauauacggcuuagacagaauuaaacuuauuuaaauaaagacagaaagacgaguguguagcagucuuaaaagauccuucccugguguguuguugacaucaucauagacucagagcccuugagauugguagaauggauuuauuaauuugucaucagccugaagguucugacugaaauuugccuuaagcguuaaugaaauagcuggggauuugagugcccauaguccucggaguuuauaaaauaucaguagaguguaggugugaagaagaaaauugguaaucuuuaccuaauaucuacuuagcuugucaaauauuugcucaguaucuguagucaaacccucuuuaagacagagggaauauaagauacaaucuuucaagucaaagaccuaaaagcagaauagggacuaugagauacaaacacaaaaagaacaaugagacauuucaaauaauuuaagaacacuaaggaagauuugcuuuaucuauauguuaagccucaccuaaacacauuaauuugaauaaaaagaaaacauuuauugagcaacuauuuuuaucaggugcugagcuaggugcuuucauauuuaugaucuuauuuaaugcaacagucuuaggagauuguucaaauauguguuggaucuaguuuuuacaaacuuauaaagacugcuccaauuaauuuuuaaaaugauucuuaaguugucauggauugcagaggagucacuagauuaaacauauuuuccaagagcuuuguacuuuuuuggaacagagugacuuuuuaaauguuauauauaucuucagaaaauguucacauuguucuguuauuuuuguucagcaaaaacaguaaagaacguuuuaccaaagaacucaaagcuacuuucuuuuggcuucucauucaguuuuaauguucaaauuccauuauguacauaguggauuaaaacacugucuggcuuugugggauaaucaaggagcuaagagcuuuguuucccaugcucuggaguuuauaggcuaguuguaaagacaauucaugaguauacaaauaacauaauauaaauaauaauagaugauaauacaaaaauaacacaacauagccaauuauggaccuaauuaccaaaauggucauauauauaauauacucaaauaaauucacaagagaggagaggauuuugaacuaagaguugaagauuauuugugaaccaugaagacagaaggcauuccauugagaguaaugauauacucagaagucuaaaagcaaagaggauaaagcauguuaaaggucuuaaagggaaggaucauagaaacaggcugaggcuagacuguggaguguuuugacagcaaggcucaagagacugaucuuauaacaguggcaaguagcuaaaauuaucacagcagagaaauuggauaauaaaguucauggggaugaauucaguuuuacaguacaggagaagagcuggacauagccuggagaagggagaugaguuagaagaauaguuccguagucaagguaccauuugugaagaagggcuugaaguaggucaguaaccuucaguuggccccagcaaugagaaacuggaugucagagauaaagggguagaacuauauaucaaugcugaucacggauuagguaugaaggaacauuuaacaggaagaacgggagggaggagggaaggaaggaggggagggagggagagaggaaggaaagaaggaagaaaggaggaaaggaugggagggagagagaagggccaagcuaguuuggaagacaaugguuuuaguuauauugaguugauggugaugaggacacagaaguggaaugcuuaacagaaagcuggaguuauaggacuacagcucuggagaaaggccaagacuuaagauucuggaaucauauagaauagugguucucaaccagacacaguuuuggucccaggggacauuuggcaaugccugaagacauuuuugguugucaccacugaggggaaugcuacugacaucuaguggguggaggccagagauguggcuaaacacccuacagaacauagaagagcuccucacaacaaaggaucauccaacccaaaguugagaaacccugauacagagaagaagaauuaauacauuuuucuuggaaaauaugucuaaucuagugacuccucugcaauccaugacaacuugagaaucauuuaaaaauuaauuggaacagucuuuauaaguuuguaaaaacuagguccaacacauauuugaauaaucuucuaaggcuguugcauuaaauaagaucauaaaugugaaauagcaccaaacaaggaagaacauguggaaucaucagccaaaaggcuaaggacuucuuagcaaaaaccuacaucuaagcgauguuaauagaaaguggaaauagcauaggacacaaagaagcaaagaggagagauggagguaagcaagaaccaauuuacugacucauucauccaaccaauauuuauugacaacuauuauauaagagguaauaagugcuagggauacgggaaugccuucucagagcuuauaguuuagaagagggugacagugugcaggaaaaggacauaauuauuagaugauggggagugcuauaauaaaggcaacaaaauggggauccccaaaagagagggucuuggggcugugauggaaggguauaaauggacugagaugagaugaugagaugagauaagauggugaggcaaggcucucugaggaggucacauuuggguugagaacugaaaggagagaaaccaguccugaggagagcugaaaugauucugucauggauuccaagggaggaggagaagggcuuaagggggagucagaaguaccaaagccuacaaagcugcccagcugggcaccuuugcauuuguuaaugaggaggccaccuggguccuggacagcugcagucuugaaagauaagaauauaaauuaugagucuaaauuuucuaaucauuuaugagagaaaaaaaaaaacagauuuugauuugggggaauuuuagguaguacugcgagagaccccgguuagaguucuguuggaauaugucaggcacuugaucuucuugccaauuuucuccacaaaaauuagacauccuuauacaacacaaaaccaugcagugauugaacgcaaaugcuaauauuaaucauaccuuuucuuuucuuccccaggcuucacaaggcuuacugcucaggcaguaucuauuguaaucagcaaguuaccuacggugauugcauguuugccucccccaguuaaauacuucuuuuuucugucugagagaaaaaugucaaaaaaauuuguugaauugaagaaagcuggccugcuugucuggaacuugauuguaauuauaugucggauauuugaggacggaaacacuguggaacuuuuaacaggugccucucuugacagauggaguaaagaaaaauuggguuuaauuuguauguguuugaaaagcaucaugggagaccagacaaguauccauaaucaaaugauccaaaaggucauacagagcauugagcagcagaagcccaacuggauugaacgucaauuguugaaagcaaggaaacugagcacugaaugguaaagugauguuuuucucuuauuggauuucaucaaaugcuuucacaauaacaaaaucaccaauaaaugacaauauauugucagaugggcagcaguaguauuuugcuaaauucauggcagcuuugaugaauauaaaaaaagauaaguaucccauuaaaaauuggauuguugcacauuucuugucuucuuaaaaugugaaccccauugacacacuggaacauuauacuuguuuagucaccaucuuaagguuucugauuaaaagggugguaguuaaacccaggagaauuuaguuucaccccuuuucagugugcaaacagguaucuaguggauagccuggagcauuuuguaaauggauugggcauggagauuaaauuaagaaggaauuaacggauauaaaaggcuuuuuauugcuuucuguguaccugauugucaaaaagguacacauuuuucaucugguaauguaagaaucccagagggcaacuagggcauaucacacuccagcuauaaacacacccagcuguuucuguaugaaaaugucagccuucucauggguuugucacuaagagcuaagugauuugugguacugcaaagauuuuuaagggucccugaugaguugaaauauguacauagaguccuccugucuuuaaauuagucuucagguauagaauugcaugguauugauaaaggaauuccagcucacauggucuacagaucacugucagcccauuuuaaaaacaccgacacaugcugucccucauucuuuaaaaauauauucauguugcuagcagauacuaguauaacuuucugcccaaaaugacuaaaagucacuugaaauaugguuacucuuacuaguacaugguagugauaaagagaucaggcuuuggagucagaugggcgaguacaaaucccuuguaaaugggucaucuugugcaaguuauugaaucgcucaaagccucaguuucaaugaugauaccacacugacagaauuguuuugaaaaauuaaauaacauucauggaguucuuagcaucaagcuuggaacugauaggcauuauuauguauaaacucuauuaaaauauauugcauucacugguuaguauuaagguaacuaauaauguuuacuugucuauguuaaucuauaagacuucauauuaauccaaauggggaaaaguagguaaucaugauuuuccuggucucaucauacugaccucuagaaauguacuucuggagugucccauggguggcaauaacaauagcauucaggcaaaugcuuaguaacauuggcagugaccgucuuaaucuuucuauuugcauucaacacuaauuuacaggcuuuaauccaaugacuaaaaaauuaaggccugaugucauuauccauggcagugguuauaaaggggagcggaaaaacaagaguaaaaauaguauaucugauuauagugacaaaguuaaauuuaugauacugcucauuuaguagccccuauaucaaauaagguccauuuaaagcaaugucuagguaauauaccuagggguacauacaagaaucuauaagcuaaauuuuuuccuuaaaaucugauuucaauuuaaguuuuauaaacagccccaacacaucugguaucuccuauacggggaguugucgagcuaauauuuggcugauuaacaaugagccaaaagaguauuuaucucacauacaacaugcauaaaaaaugaagaauugcugacuuaaaaaaugcaguacagcccucaaaguuucugaguaauuauauaauuagcacaaugcuacaucuuucucaauuucugaaaugauaucaauauacaaagugcaguuuuaaaguuauuuuuggcauaguuuuuuaaaguuauuuauggcauuuauuugaaaaagaguuaaauuugacuuaacucacuuuagauaacaaucucuuacagaguuugggcacuguaaguguuucuuggcugggcgcaguggcucacaccuguaauccccacauuuugggaggcuaaggcaggcggaucaccugaggucaggaguucgagaccagccugacugauaugaugaaaccccgucucuacaaaaaauacaaaaaaaaaauuagcuggguguggugguaggcaccuguaaucccagcugagggaggcugagacaggagaaucgcuugaacccgggaggcggagguugccgugagccgagauugcgccauugcacuccagccugggcaacaagagugaaacucugucucaaaaaaaaaaaaaaaagaguguuucuucuugacuuugauuucaaauugauuaucuguuauacaagugcacuuccacucuaaguacuucucacuaaucaguggucauuuuacucauagauauacacugugaggaaaaauguauuucaaaacaugaugccuguauuagguagaggguugccuugguucuaccauaauuuaaaaaaauauaugaguauguaagcauuuaaacuaaaaugguucuucuguuaagauccauuaaaucuuaauuacuuaugaagauuaucugaaacuacaugauaccauuuagcuagauuccuuucacuugcauccagauuuaacuuugauuuuauggaaauggugaaaauaacugcaguggaaaagguggcagcuguaaguguugccugucuugcauacugccugaaagcauuacuauucauuaaaauaaccuucacuuuguaguaacacucaagcuguaaacagucaacuuagauucuggagaacacacagcccaaaaaguaaagaaguaucugucuuugcaaaguaauuugucgaguugaagauuauuguuuuucaucauggugacccugacuuggcuggcugggugcauauacagauuaagauuaaugcaguuauuccuuggcuaaggucugccucuuucagggcacauucucccuaaugacaugauugauaggcagucccaaauccggagaggaacucauuaaucauagcauugacugaauccaaucauuugcuucaccugcacagugauggacaggaaaggauacaauucaggagcugacacugagauacuccuuuguuuaaaaggccucaacuuuuucaaugucagccucuacaaaacccgacaagaauuuuuuuuuuuuuugcaaccuguaugcaccuucaaaaagauaccugcaaacuuauuuuauuguaaaaaggucuuuuaaaaaaacaagcaauuuacucuagcuaaugaauaucucuaagucaaaguaggauuuucuuuauuuuuuagcaaggcuauaugaucuuaaaguuccuccucuuuucugagaaggauguuuugaagauacauguggaagcaauaucaaaguuaauguccagcagcugggugucauuugguucagucuucaggucagcggcauugacucuuagcagaacuaauuuuauaaucauggcaaaaucucaguaaugaacugcaguauacagcugauuacaccacagaaaauuuuauuuagucuuggaaacaguggaaaaccaugaguuuuaagaauacuuacauugcaaaguguagcaugaucccaauaacaauuacaacaagaaaauuaguguggaauauauguguacauugaauaucauaauuuuuugcacugguauaguuugaaauguuuaaauucuuuuugucauccauuauuaccauguaaauaaugcucaaaaucaacaauauguauauagaucauucuaaaagaaauguuuuagaacuauaucuugcacauuccuggugugguguuaguagacuuuuuuucuggaagaauaaucaagauagugacuugugcuaaguaucuguuacagaaagaaacaggagugggucacauauuuuuaaaaggcaacaagugucaaaggccaauuuaaaauacccagugguaagcauaccgccaugaagcacccagccuauauuuagcauaauaggcucccccuuuugacacuucaauuagucuucaauguguucuacaacagguguaaagaggaagcuacaaaagacaaaauaccaaagcuauuucaggcaucaaagauacuuuuuauccacaaagagaaaauacaaauuauuucuuacauguucauaaaaagaaauguuuuguuuucaucucaugauuauagcaauuucaacaauugcaguaaugggaaaauguuuuauagauaggaguauaaaugcaguaaagacauguuuuagaagaaacgauucaauuuuugaaaaugcuuucaggugcuuaauucuaaggugcuguuuaugugaguggcagcgguuugggaaggcuuaccuauuucagcguagucuuuauggaugcuuugaaucugagauuuacaucaacucuccacacuccaucuccaugauuacucuccaucuuuacaauucuucacuacugauauguauaugcuuucuuuguauuuagugcauuuaugacaauagagaaaagcacggccuuacaagaaggagauguugcucuugaacugacugagcagaaaauaaacacgaugguccuggaucucugccacaaaccagguggcagggaguaccugaggcaaauuuaucacaucaugcagcucaaugagguagggaaacggccuuuuuaucgagcaauuagguguguacuggccugaggcagcgucugcuggcagcuaaggguuagucaaggaggugauaauacuucuuaaagucaauaccaaacucaauauugcauuauuaauagaaucuauucagccccggcuguucugcauuuauacagaaaaagcuucaccgaaacaauguagauuuuauuuauaugguuuaaacaauaacauggcucauaaacucaguucaguucugaauuguagagacuagagguguaguuugggaauuguguguuugugacuguuaagcugauguuaaaaucugguauuuguacagugaauuuucagaagagacuuagcucuuuuccugcagauaucaugcuuguguuggugaggcuggagauuucuuauuuaaugaaaaaacuuaaagaagaguauugaaccauauucgguagcaaccagauuaaccuaggaaaauucauuaauacacagacacugguugaaccaauguuaugccuuucuaucccauugccucugaccuugcauguuuuuggcuguuuuauugaaaauguaaauagcacguuaucucagcuauuuacuugaaacaaaguucucuaacuuaaucagguuuugaauuugaucauaugugucugaauuagauuguggcaucuaauugcguuuauauuugcaaauacaugaauguaauuuuuggaauaguaaaaauuguauaaugugaauauauaguguuuuaguuuuaucucaauaauguaggccuuauaaccauacauuuucagggaauaaauuaaauuugacaacagcauuuuacaacuugauuauauaaacguuuugcccaccauuagcuaugugaaaguuacuucaaguaaaucuuguuuccuggauuucauagaucaaacagucgauaaacaggugacauaacaauguauuccaugauagccugagaaggauguaagaaauuuguagcuaugagauaugacccuguccuuaaggcacgagagcucaguuuguaauuguuacaaagcaacacaaccuauucacucuugucagugauccucauagcuugcuuaggguuucuaucugggaaacucagaaaccccucacccuggcaaacugaaagaccucuauugcaaagugaugcuccucauugguaugugcacuuggccauucggauuggccaaaguaauugugacaacuacugaggaacagauguugcagugugguuacccccauauccuuagccaagcaguguuacaauagcucugaggaugguaaaccuggucugaauugccaaacugauagaacgguccuauuuuuaaaaggugcauaauauuaaaaagcucaauaaucaccaauaagcaauaucauccaaaauugaauugacuacuuauuggccaucaguuauccgguuauacucuggaaagccaaaggcuguacuucccucauagagcucauauaacucugacauagugauucugaacaggauaccaugagauuacacugggauaccaccacauuuugcucaguguuaugauuuaucuuguuacaacugaguauauuuacuguuauaguaaugucuaucagaugggauauagagcuaaguauuuggugguuuacugggcugaaugaggcauggcacugcaagguaagaggcauaauguuaggugaggcuagaggcaaagaaagguaccuuugccuuguaacuauuacaaaaacacaggcaauaagcccaaacaacacaagcaugacuagcugacuagcauaguacuuaugacugcuuuuccacugugagguguugcuaugcuguaagugacauugcauugugauguuuguucauuucaugaguaguguuaugagucuuuagcaccuucagaugugcugcuaaauguuucucaagaauguaauguaaauagugaagcauuuauggguacaggccuagcugaggggaagaaugggugugccauucauagagacaaagaagucaucagggaaaaugagguuaaagaugcuuugucuuugagauaaagauaagauguccaagcaaaaaugucucaugauaguuaaggcccugaccaugauguugugccacaccccuaucaacucccaugggguuggcaccagguucaagaggcugaagagacccagagcuggcccacaagacaugggguuuuacugggagcuuacauacagggaagagaguccaaugguagugggcugggcaggaaaaccacaaccacuugcaagaggcaugcaguuuauacagcauuuucauuuaacacccucuaccuagcaaccuccaccugacgaccuucauuuaacccaaaacaaagggccucaauccccuguauggcuccaguacugugggauagggccaggggcuuagagguuccucacagauaaggaauggaucucggguuggccacucccagauuccuuagcuuggaacucugaaaacacauucaagugcaucugccauacagggucauucucagaguaugaucaaguaaugaccgucaggugcaucuaccauacacaugggcacaaaugagagcagacaugcauauagauuuggucuauauaugagugugguaguugaggucaucagacugacagagcucuucagugaagagaaauggagaaaugaugaauagaggaauaagcuuugacauaaugcacagggaagguguucaagaaagaauggaaaucuucuaaagauauggcccaauuagugguaaaucugauuaaagcaaugucacaguuaaagaaucugagguuaagaaggguuagugaugacugucagugcaguaccuagaaagaucaacaaaggagaacauuccauuuucuucacaauuugcaacagaacaguuucucuuuuuugaauaguggaaacagucaaaauguaguuacguaaggcgaaaucaguuaagacagauuguuauuagccaaaacaaagcuuuuuugucaauaaaaacgaaaguauuccuuuuaaaaauuuuauuugcauaaaucauaauggagaaaaguuuuguuucuguucaauaaucuaaaucuaggcauaaaacuauuuucugauggcuuuaucauuaacaauguuuaguaagaguccaugugugacccuccaucagacacuaaagaauuaaucuuucuaaaaagauaugcucuacaacagggguccccaacccccgggccacagaccucuaccaguugguggccuguuaggaacugggcuguacagcaggaggugaguggcgggauagugugcauuaccaccugagcuccaccuaucgucauaucagcagcagcauuagauucucauaggagcaugaacccuauugugaacugcacauuugagggauuuauguuguguguuccuuaugagaaucuaaugccugaugaucugagguggaacaguuucauccuaaaaccauacucccccuccccacgguccauguccauggaaaaauugucuuccaggaaacuggucccuggugcuaaaaagauugcggacugcugcucuauaacaaguaaguucaaaaacgaugauuguuaacuucagcagugguuucuuucaauuuuuaggguuuuauaauauaaaauuugccucucaugaugaacacagugggcauuccuaaaguuauagaggcacagaaaaaagcacagugaacugagaccagaaauguggcuccuccccacagcuuuaccucucacaccugugugaucucaggauuguccucugaccuuucagcaccaaccauugaggguggcauucggcuagaguuucccugugccuauggaucuccugggaguuccuuuuuuuuuuuuuuauuuuugagauggagucucucugucgcccaggcuggagugcaguggugcgaucucagcuuacuguaaccuccaccucccggguucaagugauucuccugccucagccuccuaaguagcugggauuacaggugcccaccaccacacucagcuaauuuuuuguauuuuuaguagagaugggguuucaccauguuggccaggcuggucuggaacucccaaccuuaagugaucugcccaccucggucucccaaagugcugggauuacaggugugaaccacugcacccagcugggaaugcucauuaacaggcagguucugauucaauaggguucaagauucugcuuuucuaacaagcucccaggugaggcuuaacucagcugauccagugccccagacuuugaguagcacagguuuucuaaaugaugucugaauaccuuuuuggcucuaacauucugaacuucauccuaacccuaaccucaaagaaaaaaauuacauugugacacaugaaacaucacaagaacauuuauauuuuuuaaaaucuauuagaugacuuauuuauuaauaguaagcauuuauuaguugauggggacuuuuagucauuuuaauuugucaucuuccagaaaaaguuccauaaaauacauaaggauuguucaccuuauuuauggguggaaaaugagguauaauguuguagauuggcuuuuuuuuugcccaggccugcacuggcaguugggggauuauaaugacauauuuugagcuucucuugagccuugauauuuuucacuccaugggauggaaauagaguuuaggagcuugcauuauaauuaauucugcauugaaugagacugcuugcaguaaaauaucagaguacucagugcucugcugagccaggaguaguuaacaacuacacuuaaugaauggaugggcaaucuuauacugugaauaaucaugcagaugaguuaaguuuugguaaccagacacguuaauaugugaaccagugacaagacaaugccuguuaaaaagguccugauauaucaaacauauauucauuauauaagaguuugguaaaugguuuccuaaucuauacuaaauauuagguaaaccuguuuuugauggguuuauugcaaugcugauugguacucuacuauguaucuucugaaaauauauucuucccugaggcaaguaauacacuguaaucuagcaaaugugcugaaaggauaaauuuggauauugaucaguuuauuuuuacagagaaugucugcuucucaccgucacaacuuguaauuucuuuucuuugaaggaauauuuaaaagaacagcuguuuucuaugaauaguucagaggaaaagccauuacccauccgaccuuuaaagacgaccuugaggaguauagaagaucagccuucugccuuuaacccuuuccauguguauaaggcguuuagugaaaacaugcuagaucagguauguggaaauuaaaugguaaauuuaauuuaaaugugugguuucuuuacccaaguaagaaaaaauugcuuuguguuugaguauuuacucauaagcuuauuuugcuaggaagcaaaaggccuuguucuuauuuacauggucuguacaaauugacuuuuaagaguuauuuuaccuuuuuucuauuugucaaacugauucauauguuuggucuguaaaacuuaacuuuuggcuggucaguuuaccaugggcagagggaacaucuguuaggcugugucuacagaagcugaagaaccaggcauuuuguaacauuccuuuccucccuugccacccccaucccccaauacacacacucacaaaauaccuugcaaccuuuacgaauuuaucaggcaaauuagaaaauaguuaaaauuaauuauaaauagagcacugagcuccuacuuuaagugguaugggguaaguuugcuuuuuauaaccauagacacauucccaaauuuaaaaugaauuuguuaaugaucuuaaagccggucuauuuggaauaaagucaaugugauaaacaccacacauuuuuuaaugucagauuaugccaucgucuaagccgcauguuucaguaguuacacugaaaagaucgucuuucugccaaaguauuugaaauauaaaguugcuuuugcuuuguucauucuucugguggcuuuucccagaaaccucuugacagacaauuugaacuaacagggcagaagagaaggauugcuugaccuagaacucugaugaaaauaagaauuaaaacaauggccuaauucagcaugcagauaauauuuuuaccaugccuguuacagcucuagucuacacucaucaauacuguaguggaguaagaccuucaaaugcugacaacccaggguggaauucuccugcucuaugacaggauuguagugcucuauuaaucagcaggugacaggggauagcucuuguuggauuuuaaacgucagucuggacucuuguuuucaaaacuauuucauuuuaaggagcauaagcauuuauaauacuuuaaauguacuaaguuugaguuuauuggcugcuuuucuguguugugcauuagauugcuccaaaccauaaauaauuauuauagcuguuaaauuuuccuuacuucauuuaaauaaauggcauauuuuauugaguucugaauuaugagauuuuuuucacaguaauuuuucuccauagucuguugugaaauuucuauuaaugagaaaaaggaaucacuuauauaauuuacacuuacagauccucauaaucuucccuuuaaagcauuuucuuaaccaaaaagguaacauuaauaucacacucuaauuaagcuguaucuuauaauuugauucuuagcacuuccaaguuuguuuuuuaaucaaacuuuugguugcugaaaagaaaaucaaacuauaaauugauaugauguaugaaaaaguugccaacuauuuugcuuugcuuuucaaacagucuccuucucagagaaacuugcugggcaaaugccauuaacacuuggaagaauaacgacucaauaaauugauuuauauuuuuauaaauaaugacuacauccccaaauggauuuauaaauuaauugccgucuuauuggaauaaaaaccuucuucuguggacaugauugauguuaucugucuaaguccuuguucuggaccccccuccuucuuaguuagucuaucacagcuggagcuuuaauuuacugaucauauuaacucugauuaauaacuaacaauagugucuucucauuuaucaacagucagccaucacaaaauggaacuggaauugggcaaaguugcugccaaauuaucugagacuggauaagaugaccuucagugugcugcucaaaaacagguaauaaaauuggggaccuugggggucugguugagggacaagguugugugugugcguguguguguguauacacguacacagauuuuacuagcauacuuuugggaaaagugaaaacauuuuaucagcaggggaaucuauuuuguuuucuuccucuccagccucccaucuuuuaaaaauauggcuauuuauaggaguauacucucuaaauaccauucucuauaguaaaaauuuguaaaaggcaguaacauuuguuucagagaugagauuaguggauuuuagacugaauuuuaaauauuuuugacuuuguauauuuaauaguucacuauuguaaagaccaaaaguuauugacuugaacguuauuauaauacuacaccuuuguuuacaacaacuuaaugaaugcguauaaaaugccaagccaaaucaacuagucuaaucaggaaaacauguaaguaaaacugucaugauugaauuuuucacuuuucagccaguuauguugguacugucuuaauauagccacaguagcauauuauuuuacacaaagauacacacacacacacacacacacacacacacacacacagagcaguauaauccaaugaaaugauaauaugauuucagccuaggaaacaacauguaauuuauuuugcacaaaaguaugaacauuuugcuuuggaucaauuaacaugguuuuuaaauacuuaaaguuucaguaaaaacuauaagguguaaacuuuaaaaauuuggauuuuuaaucaaguauaauacauuuucaaauaagauauauuuuaugauauuccuuuuauuguuugagucgucugugugcuuauagcuaaguuugaggcuuaucgucuauaugaucuuugugacauagaauguauuuccauaucuuuuugcaaaaauauugaguaucuuuuuuuugaaagaaaauaaugauaauaacauaguagaauugucaaaucauucuugagaaaucuggaugaauauaagaaaauauccuaagagagagguugcaguauuucucagaaggaaguuauagaggcagcuuuauugccaauaaaagcuauagcuuagaugugaggucacagugguauuuauaauauuucaccccugaauuaagcucacacacccaucauagacaaaguucaacaacccagaagcuuacugaucaaggccagagccuuuccccagcaagcuuaccaccuggcuggcagcaguccagagguacccuauucauacacaagucaccaggugugcaccuauacugucccaaagauauuuggagaggugagaggagggguugguggaggagaggccagggccucuauugaaucuauagugacaugauguuuauacaauauuaaaugucugucuggaaacaaacuaggaaagguaaguaauuauuuuccuauuuggaaaguuuugaguuuauacagauuaacuguguuauauuuuacuaaguuuauuuucagucaugaauugcugcuuccaauccacuaaaugguccucuagggacaaacauccuucaaaacuuacuacauuuccuuuuuauaauauucaccucuaagugaauuuguguuuuacacagaauugcauauuuuuguuuuuguuuaaggacuuuggaucacuagcuguuaaaguguauuuucuugagaucugugcaggagugggugggagaaaagaacucauacaaauuuagccagaaauaacaggucaaaacaguucucuuggaaaagggucaugaauuuuuaauagaaacagcuagaaucucaucuuaauaagaaccuuagauuuuuaaagaaugguaugaaaaucauucuacugcaaagcuaccgcacacgagcuaugaugaaccuaauugauccaccuuagaaggauuaaagacaccugaggguuuacaggcuuuucuaucgcucaccgauuuauuuuaagaagguuauuuaugaguuuuguuuaauauugaaccgguaaggaaauuguuaguuucucgaugacacccucuugucucucuuguuggaacuuaucugaaaaugccgauuuuuuuaauaguacauuuaauuguugacaacaugguuaucugaaagauacauacuugaaaauuagaccauagaacucugagcuuuuaaaaugaaaguuauauaugcuauccaacaucuaccaacuaugguguuugggguuagguguagccaaaggaaagaauucagagcaguucagcugaauaugcucaguuuuuuccuuccaaauucaccaauuaaaugagucacuuuuucucuuuuugcuccuuuuauugguaauauauuuguauuagucuaucucuauacuacauucuaguguauguauggggcugugaauguugucugaggacauaauauuacaaagaaaagugaacugaaauauacaaguaugaaaaaaauugaagauaagggaaaagaauccuuucuauucaccuuaaauucauuugugccuugucuucaacguucauauaauaagcaggccaucuguggaauuagucuccccacaugccuagaguacacuagaccucccucacccccuaaauaugauggagacuggaaagcaggauuccuguguucucaggcacuuacuuugacuuuagauuuccuuaucuuuaaaauaaaauaauaauaauuguaaagcuacuucauggagauuguugacacggucaagagugcuaaaguauuuggaaguguuuuugaaagcugauaacacaauacagucaucccucaguaucuauuagggacugaucccaagacccccucagauacuaaaucccacagaugccaagucccugauauaaaauggugucauauuugcauauaaccuaugcauauccacccauguacuuuaaaucaucucuagauuacuuucaauaccuaaugcaauucucacacaucacugcauuuguguggauucaauguaauacucggcaugcaacaaaugcaaguuuugcuuuuuggaacucaguggaauuuuuuuucccaaauauuuucuaucugagguugacugaauucauggaugcagaacccacagacacagaggcaccaccguacauauucaaaaaaguaguaacauagcagcaguuuuggugucuagucagguaaggaaacuguaaaguccauuaaggauuaguaggaaguugcuguaagaucgaacacucagaacauccagguuauguggacuccaggccuaaaccacuagugaggaucagaaaaaguaucagaucagaaaccaggcaacaggcccacaggucuggaagacaaacagaaaaugagcaagaaggaaggucaaaaagccaagugaaccacucagguaauaaagacccaggagauaaagacuugagggaccgcucagacacaugaaagaggagaucuguggggccacaacaaugucuguaucugagucaauacuggccuuuguuccacaggcugguucugugcugacugcaaaggcagaacaaaucuugaagcagcugccugaguccuuggcaaaaauguguucuucgcucacuaucuggccucaucucaaaacaucuccuuccgauucaugaugcucuaaauagaaugcuuucuuuaaguuauuuggauucucuaaacgcuuucccacuucagcgucuuggugcuugcaguucccucagcucuucacauggcuggugccaucuuguccaucugagacaaauguuaccuccugaggagacuuuucuauuucacccaucuaaagggacccuccaggcuacccuagcauucuacucuacuguguuuucuugaguuauugccaacugaaauacuuguuucuguuuauuuauugucuuuuaaucuuacccucugugguagaauguaaacucaauaagaauagcaccuuguuugccuuauccugguggugucuucauuaccuagaacagcccuugggcacagagcaggcucuaaguaguguguauugaauuaauuaauaaacaaaugaggaauaagaaugcagagaaaaagucagcuccugacagaugagcacaggguagguauucuuaugugauguuugguuaauagacauguagguauuauaagaauauuugcuggaaaaucugaaguaaaaaaguaucuauaugcauauucauucucuucauuuuccaaauuugggugaaagucagguuauuuaagcucuguauguuuaaaaugucuguuguaauagccacaaaaagaauaaaguaucggccaggcacgguggcucacgccuguaaccccagcacuuugggaggcugaggcggguggaucaugaggucaggagaucgagaccauccuggcuaacauggugaaaucccgucuuuacuaaaaauacgagaaauuagccgggcguggugguaggcaccuguagucccagcuacuggggaggcugaggcaggagaauggcgugagcccaggagguggagcuugcagugagccgagaucaugccacugcacugcagccugggcuagagagcaagacuccuucucaaaaaaaaaaaaaaaaaaaaaaaaaaagaauaaaauaccuaggaauacagcuaaccagggaggugugaaacaucucuacaacaagaauuacaaaguacugcucaaagaaaucagagaugaaaaaaagcaaauggaaacauuccauggucauggauaggaauaaucaauauuguuaaaauggccauacugcccaaaguaauuuacagauucaaugcuauucccaucaaacuaccaauaacauucuucacagaauuaguuauuuuaaaauucauauggaacaaaaaaagagccugaauagcaaaggcaauccuagcaaaaagaacaaagcuggagguaucauguuaccugacuucaaguuauauuacaaggcuacuguaaccaaaacagcaugguaugguacaaaaacagacccauagaccaauggaacagaauagugagccuagaaauaaugccacagagcuacaaccaucugaucuucaaaguucacaaaaacaagcaauggguaaagaauucacuauucaauaaauggugcuaagauaacaggcaagccauacgcaaaagauugaaacugaacuccuuccuuacaccauauacaaaaaucaauucaagauuaauuaaagacuuaaauguaaaaccuaaaacuacaaaaauccuggaaaauaaccuaggaaauacuauccaggacauaggccuuggcaaagauuucacgaugaagaugcaaaagcaauugaaacaaaaaccaaaauugacaaaugggaucuaauuaaacaaaagagcuucugcacagcaaaagaaacuaucaucagaguaaacagaaaaccuacagaaugggagaaaauacuugcaaacuaugcaucugacaaaggucuaauauccaccaucuaaaaggaacuuaaacaaaucaacaagcaaaaagcaaacaaccccauuaaaaaguaggcaaaugacauaaacagacacuuuucaaagaagacauacacaugaucaacaaacauaugaaaaaaagcucaauaucacuaaauauuagagaaacgcaaaucaaagccacaaugagauagcaucucacaccagucagaauggcuacuaauaaaaagucaaaaaauaacaugcuggcaagauuaugaagaaaagggaaugcuuauacacugcuggugggcauguaaauuaguucagcccuuguggaaagcaguguagcacuuucucaaagaacuuaaaacagaauuaccauucaauucagcaaucccauuacuggguuuauacccaaaggaauagaaaucauucuacaauaaagacauaugcacguguaucuucauugcagcacuauucacaauaguuaaagacauggaaucaaccuaaaugcucaucaaugguagacugcauaaagaaaaugugacauauauacacuacagaauacuacauagccauaaaaaagaauaagaucaugucuuuugcagggauguggauggagcuggagaccauuauccuaagcaaacuuauacaggaacagaaaaccaaauacugcuuguucucacauguaagugggaacuaaauacugagaacacacagacacaaagaagggaucaacagacucugaggcuuacuugaggguagggagugggaggaggaagaucaaaaagcuaccugucaggugcuaugcuuauuaccugcaugaugaaauaaucuguacaccaaacuccugugacacgcaauuuaucuauaugacaaaccugcacauguaucccugaaccuaaaauaaaaguuaaaugaauaaauaaaacccccacuguuauuauuuuuauguaaauuuugcucagauuaaaauaacagaaagcuugucuuuauuuuuaguuaauugauccaguucaagucauaaccucuucagcaacaaagucuguuuuauacuccaagacuuauaaaucuuuugacauuuggaugacagaguuuguguuuguuaaaugauacaaaaaaugcaaguagaaaacuuuaagguggaguuagcugauaacaguauccaaccaagccuuuguaaacuaauuaugagugauuauuuugagggauuugaagaaguauauagcagccaagaccucagaaaacagauccugaauauauacuaaugauauauguguuucaauuuagaaaguuugcuauugugaaaaauaaugacucccuagaguuucagaaaaucaacauauauaucaguucuacaccuuuacuuuugaugcuaucuaagaauaaguacagugauuguacauugaucuuuugaaauaauaaagguacuuuucacaguuucuuacuauuaguuuuuugcuuuuguucucacccacuuuaaaauaaauccagacuagagaaugagauggugauugcauuugcaggagaguggaccaaaaggagcucucccuucccucauucauggcgaaacuccagauugacauuuugauauuguuuucuuugucacuggaacaaauuuauguugcuucuuuucucuuuaccuuauuuauuccaaacuaauucccaagaacugugguguugaaaauaaucugugaauacagcgcagugcugugcuauuuuaaccaucugaauauacugcauaugaguuuggcuucgaguugagcaaacacaauuaaauaugauggcaggaacagcagaaggggugguggaggcagauuucuggcugucacuuuggggccuguccagguggacaauaaccauacaucugagaggaaacagagauuagaaaacauguuuuaaaagaggcauugaucuguggaguuguuugcuuuuaaugauaauaauuauuaaaguaccuuuacccuauaucagauuacagugugugcccugugguguguagagggcagaaaauauugucucuggccugaaacuguacacacugcacucucaaaugacuguucucaggcagugcuaccauuaacacaauguuuauaguugcucacagcaguaaauuccuggugcagcagcaggcggccugguuauggagaaguggguuuaagaaaaaggagaagcugauuuugugaguacacaccucuuagucauuacauacauaugccaugccauucaaauuugguggguuuuuucaugcuccuguucccuagaaaauuguuuucuuccuuccuccaccaaaagaccucagacucagugacucgcucuacccaucaucacuguaucuucucaaacaagagaaagcuuuucucuuauccugaaaucuacagcagcaugguuuguuuguuuguuuguuuguuuguuuuuugcagagauuaucuaacauguauuuaaaaugcauaaauuugacaaucugauccucagaauuuguagggcuaagggaauugguacaugaaccaaacaaacuaauacagguguauuauuuccugauggguagcuuguaugucuguuguccuuuaugguguauaaagcacuuucacacuaaucuccuuugacucucacuacaaccauguaacaagggacagguacucuugagguugcagaacauuaaauaacaugcccaaggucacggacauuacauggcagcucaaaagagccccaagaugaagucuucugguuuuguaucuacuauaguaucugguacuuuaucuauuaauauguaccauacuucuggucaauuuuuuaauuagcugcauauuuacuguaauaauacugaugauaauaaagacagcaaacauacagagugcuuaccauauggcuggcauaauuuaggugauuuauauacacauauuuaacuguaaauccuuauaauaaccuuacaaaguagguaucauauuauuacuuuccugauaaggacacuaaggcacagagguaccgagcucuaagugauggugcucagauuuuggcucgaggccauguucuuaaucacuuccuucuagggcuucuguagagcuuuuauaaugcuuugcuuacuuuccucauucaacauuuuugaacaucuauuaaaugaaaggcauuuauuuagaauaaaguaacaauguacuagggauaucccuuauccuaggguuaucucaauauccuucaaaggacuccuuagugcuacucugcaaacuuuuuaauccauuuugaauuuucgcuuugguugucuccccccguucaagcucccaaaucccuccugcugacuuuccaccaucuaccuuaccaggaauaguaaagccaucuaaugugaaacucccagcuuuccuuccuaaaccucaauuuuguuuuaucaucuccaauccuuugccuguuaucucuagccuuggaaaaagagcccuuuucuaguuagaauuugagaaauugacuauggauugggcuaaaacauuuggauauuaaccaguagacuugagggaaucaucagagccuuuaagccaaggagugacagaaacagagagcuacuucagcacauuaauaacaccuggaguggagggacaggaggaaaggucagguuagagauuauggcuagagauugaggaagagauuauacaacacaaauauaaaagaaacuucccgggaaguuuaggggcucagaaaaaucuauuuuuggccgggugugguggcucacgcuuguaaucccagagcuuugggaggccgaggugggcagaucacgaggucaggagaucaagaucauccuggcuaacauagugaaacccugucucuacuaaaaauacaaaaaauuagccaggcauaguggcaugugucuguagucccagcuacucgggaggcugaggcaggagaaucacuugaacccuggaggcagagguugcagugagccgaggucgugccacugcacuccagcccaggcgacagagcgagacuuuaucaaaaaaaaaaaaaaaaaagagaaggaaagaaagaaaagaaaaaucuauuuuuaacaauauuuccucucuggagacagcgugauccagauauucuuaagguagaaaggugcuaugcuuaccuuuucuucagagaguguggguucagauccuccaagaagcagaugccaagauggaauucaaggugcaagaggauuuuaggagagagaugcacaugaaggauuaagaggaggaaguaggaauaggcagggaaggcuucagaaugaacucaacuucagacugaguugcugaucugauaccugugaaaggugagggcgaaggaggauuggggaggaagagucucagacagcaggguuuugacaagguccagggagaugccuggagcuaaagucacccacuagaaaagucccaugccuuguaggaauggacuagcacuaguaccuacaccuugcucagacacuggcuauaaacagcuugguagaagcaugaccucagcacaaauacuaugauagauacagaggaaugacagcuggggccauuagucaacuaugcuaacaguagaagacuugagugauacaauucuguggcuaccacagcaaagacagagagaguaauucucuuacauauggggagauuauauggauauguguuauauauguuaacaggaauaaaauauaaauaaaggucuccauuacuuuagugaaguagaaaacaggcaaccuaaauaaauauguuaaaugcuauugacagaaaugcacaacuggcaacauuuugaugaaagaaagguauaauaaguuucucaaaagcagccaugggagaauuuuugcuugucagauugaaccaaaauucacuuuguaaucaauuuucuucuaccuaauuaugcauucacauacuggcacuuucggguucuugcacuggaucaaaaacuauuuuaaaacuugcuuguauagaguacauucuuuuuuucaaugacuauuccccugucacauacuguucagacccaaaaaccucuguaauuuuuuuugcaaaaaguuuuagcauauuuuccaccaggaguagcugucauaggcccauugauucaguuugauugaagaugaagagagaauugacuucuguaaggcuuauugaugacuauuggauaucuguuugcuuaugaugcuauagcaacaugagaggaaauuaucucuuugaagauauuuuuacugugacaauuaugagagaaauuaaaauaucuaaauauaguuauauauuauaauaacaaaacugugugacaacuaguaauauucuucauuuuauguaguaacauuuauaaucgacaugauuuggcuguguccccacccaaaucucaucuugaauuguaguucccaugagagggacccagugggagguaguugaaucaugggagcgguuucccccaugcuauucucaugauagugaguaaguucuuaugagaucugaugguuuuagaaggggcuuccuccucugcuuagaucucauucucucaccugccgccauguaaagaaggacguguuugcuuccccuuccaccaagauuguaaguuuccuggggccucugcagccaugcugaacugugagucaauuaaaccucuuuccuuuauaaauuuucuuuccuuuauuaaaaaaaagauuuucuccuuuauaaaaaacuucuuuccuuuagaaauacccagucuugggucugucuucauagcagcaugagaaggaacuaauacaguaaauugguaccaagggaggagggggugcugcuauaagcauccccaaaaauguggaagcgacuuuggaacuugguaacaggcagacguuggaacaguuuagaggauucagaagaagauaggaaaauguggaagaguuuggaacuuccuagagacuuggagggcucagaagacaggaagaugugagaaaguuuugaacuuccuagaaacuuguugaauggcuuuaaccaaaaugcuaguagugauacggacaaugaaguccaggcugaggugguccaagauggagaugaggaacuuguugaaaacuggagcaaacuggacucuugcuauguguuagcaaagagacuggcagcuuuuuccccugcccuagagaucuguggaacuuugaacuugagagcaaugauuuaggguaucuggcagaagaaauuucuaaguggcaaagcauucaagcggaagcagaacauaaagguuuggaaaauuugcagacugacaaagcaauagaaaagaaaaccccauuuucuggggagaauuuaagcccacugcagaaauuugcauaaguaacgaggagcugaauguuaaucaccaagacaaugaagaaaaugucuccagagcaugucagagaccuucacggcagcccgucccauuacaggccuggagacccagaagggaaaaaugcuuuguggccugggcccagggccccccuccucugugcagcccugggacauggugcccugcaucccagcugcuucagcuccagccuuggauaaaaggggccaagguacagcucaggccauugcuucagagggugcaagcccaaaccuuggcagcuuccacgugguuugguacugcgggugcacagaagacaagaauugaaguuggaaaccucugccuagauuucagaggauguauggaaaugccuggaugucaggcagaaguuugaugcaggggcaaagcccucauggagaaccucugcuagggcaguacagaagggaaaugugggguuggagcccccacuggggcacugccuagcugaccugugagaagagggccacuauccuccagaccccagaauaguagauccacugauagcuugcaccacacaccuagaaaagcugcaggcacucagcaccagccugugaaagcagccaggaggggggcuauauccuucaaacccacagaagcagagcugcccaaggccaugggagcccaccucuugcaucagcaugacuuggaugugagacauggagucaaaggagaucauuuuggaauuuuaagguuuaauaacuuuccuauuggaguuuggacuuguguggggcauguaauugcuuuguuuuggccaauuucucucauuuggaacagguguauuuacccaaugccuguacccccauuguaucuaggaaguaaccaacuugcuuuugauuuuacaggcuuauaggcugagggacuugccuuguuucagaugagacuuuggacuuggacuuuuggguuaauguuggagugaauuaagacuuuaauggacuguugggaaggcaugauuguguuuugaaaugugaggacaugagauuuuggaggggccaggggcagaaugauacaguuuggcugugugcccauuccaaaucucaucuugaauuuuaguuuccauaauucccccguguugugggagggacucgguaggagguaacugaaucaugggggugguuucccccauacuguucuagugauagugagugaguucucaugauaucugaugguuuaauaaggggcuuccccccucgcucggcucucauucuucucucuccugcugccuuuaaagaaggauguauuugcuuccccuuccaucaugauuguaaguuuccugaggccuccccagcccugcagaacagugagucaauuaagccucuuuccuuuauaaauuacccagucuuggguaugucccuauagcagcguaagaauggacuuauaaaauaauacuauuaauauuacaguauuuuugugaugugauguguauuaaauuaguuaggauaccuguaggacuuucuuauacuguaagugaaacucauaccuuaguguaccuugaggauacagcucuaaaccugagcuuuuuuucuccucauagugugaaaucugguguaaaauuuuuuaaaucaggauguuuuuauauucagaauauuuaaaauuuuuauuuuauaauaaacuauaagcaauauuuauacacauauuauuucaaaugguacaggaagauauaaaauauaaaauaucccacccgcucccccaccagcuccugaaucacacaagucucacucuaauuguaaucauuugaagcauuucuguuuuuauuuauugguugauaagucuaaggaauaggcuaugacacuacguuuuuuuguuuuguuuuguuuuguuuuguuuuuuugagacagagucucccucugucgcccaagcuggagugcaguggcaugaucucagcucacugcaaagcucugucucccgguuucaugccauucuccugccucaggcucccgaguagcugggacuacaggcucccaccaccacgcccagcuacuuuuuuuguauuuuuuuaguaaagaagggguuucacuguguuagccaggaugaucucgaucuccugaccucgugaucugcccgccucggccucccaaagugcugggauuacaggcuucagccacagcaaccggccgauacuauguuuuuaaauuuaucaacuuauaauauugacuccuugcaauguaaauauagaauuuaacucaaacuaccaucucucuucuccuucccaucaaacucugcuaauaaaaauuuuaauuuuauuuuuccauuccucaccuuuaucugauauaaccccuauuuuaaaaucauuucucuacuuauauuuuauuuuuuaaagaauuacugaaguaaaauucaguguucuuguacaguucugaguuacaacaaaugaauaaaguuguuuaacaaucaucacaguugaaauacagagaguuuuaucacccucaaaaauuccucugugcugacccuuuguuacuuucuaccuccaugccaaccuguggcaaccacugacccguucucuaucccuauaauuuuguccuuucaagaaugcuauagcaauggauuccuccguuuguuuguccuuuuuuuuuuauuuuuuuuguauaauaguaguucauuguaugguuguaccacaguuuuuugaucuauucaccuuuuaaaggacauuuggauuguuuccaguauuaagugauugugaauaaagccucuaaaaacauuuguauacagguuuugcaugaacauagguuuuuauuucacuuggauaguaccuaggagugggagugcugguuguaccauacauuuauguuuacauuuaugaagaaacuauggcuucuuguguuuuaugcugaaacuauggcuucucguguuuuaugcugaaacuauggcuucuuguguuuuaugcucccugugagaaaacugaugccagacugauucuuuuuccccuauccucucccuggaugcucuuagugacuucuucccucaguuauucugaaaugagaucgugucuauauacgagucuuugguuucucuuggcacucaguaggccacaucaauauugugauuuucuucagauaaaaggauauuuuuuccuauuuuugauuauuuuccuugccucaggccccaguuacauuuaucuccccuucugcaauucuuaagacagauguucugauuucuucuuuccucagacauugcuaaaggcuucuuagccucaauccucucauucucacacucuccacauccuucccaccucuuuuccugaagcuaacucauucgcucacauagccucaggugauuaucucagguauugaaaucaaaugccuucaggggcugggcaaguaauguaaauaugucaaggcaaaguauaauacaauaggggaaggugaaugcauucacauucuauuuuuuaaaaauucuaugcuagcuaaauaaugcuugucaucagaauggauuaggcccaaugauaugaucaggcccaccucuaaaucugugcccccgagucuugaauccguaucucuagccuuaauuguuccacacaacagcucuagauuccauauucuuggauuuuuuuccccuuaauaauauuuuauuuauauuuauuuauuugucuaggucucacucugucaccuaggcuggaguguagugcuucaaucuuggcucacuccagccucaaugccccaggaccaagugauccucccuccucaaccuccugaauagcugggacuacaggcucacucagcuaauuuuuguauuuuuaguagagaagggguuuugccauguugcccggucuggucucgaacuccugggcucaagcagucugcuuggcucaaccucccaaagugcugagauuacaggugugagccaccauaaccagcccauaauaguaauuuaauauaauaacucucaucucacacagaaguccaaccaucauaauuaucuucaucuaaaaacugcccucucuucagaguugugugauuucuauuaauggcacuaacaggcugcuggccuuagccuagaaaccuugaaguacuuugccaaguuucuauuucccaucaucuaaauucuguuagagaauacaugccuccgaguguuuccucuaaacauuucucacacccguuucuuuuuguucccauaugccuccacucucaaaauucagugcccucuccugcucaugccuccagagccuguuuuacuccagcuggaaugucucuaaucuguguaucugcuggauuaacuugguuucucuccuuacauuuuuccuucacuguaaaaccaauugcaaauaacuggucaggggugguggcucacaccuguaaucccagaacuuugggagguccaggguggguggaucccuugagccuaggaguucgagacuagccugggcaacaugcagaaacccuauuucuacaaaaaauacaaaaauuaauugggugucguggugcacaccugugguuccagcuacuccgggggcugagguggcaggauugcuugagcccagaaagucgggacuguagugagcugugauugcaucacuucacucuagucuagguaaauuacagauaauacuaaguaacauuuuuaaaacaaagaaauaguauauuuauaaucucaucccaccaugcugacucagcucuuuucuccucauucucuuuuauguacacaacacacaccuuuuacacagucacaaugaggaggucuauauuuacaauggguguucuacauuuuucacaaaacuauucuugugacucauccauguaaagauacagaguuuuuauuuuuuaauggcuuagcuuuauaccaaauuaauguagcacaauuuaccuaaucauuucucuauuccuguacauuuaaggcugcuuccacauuuuugcuuugcugcuuuuacauauuaaacugccaugaauacgcagauacuuuuugaugcugauagaauaagggugaaacauaaaaggacacagacaaaucuguuuuaaaaauuaccaaguaucaaagggauaagagcuggagugaaguacagagauuuuuaaauauauuuucuuuuucugccacucuuccacuucaaaacuugcagugaugacacauugucuguagcaucaaacccaaacucuucagucccaaugucaaggcauccuucaccugguccugucauucaccaaguaccuccacuguggcaaaaaauccuacaggguucaaauccuuucucuaucacuuuaucacuuucucuaggcuuccuuuuucuuaucccuauuucuauuuuuuuuuugagaucgagugucgcucuuguugcccaggcuggagugcaauggugccaucuuggcucacugcaaccuccgccucccagguucaagugauucuccugccucagccuccuaaguagcugggauuacaggcgcccgccaccacgucugccuaauuuuuuguauuuuuauuagagaugggguuucaucauguuggccaggcuggccucaaacuccucaccucgggugauccacccgccucagccucccaaagugcugggauuacgggccccuauuucuuacaacagguguaaaaaauaaaguggagguuccucuucaaagaauuuccuccccauuuaauuaggaauaaauaguaacuugucuuagaagcaaaauguauucaaagaccugugcuucuaaauauuugcccuggcauguuuguacuggcccaagcaagcauuaggucauagccuguuccucuuccuuauuuaaaaguguuuuuaccuuucucagcauuccacaaguuacuuccuccuucuuuguucuccucuacauuuaccucuuuuauaaaguucuaacuugcuagccaaucaggucaaacacagaaugugaggucccguuccagccaguagaaaccggacacaacaguaagguggacgcaucaaguuauaaaugacccugucuccuuuguuugggguacugucguggaaaaacuccuggcaaguguacccuuucugcaagaaguaaaaauggccuuacuaaauaaauuaaauuuauguccaagugcuauuuucuuuacagcacugaagaacaaacauuucaaacacagggaaaauagcagcaucuuucuugcugaguggcugggaaaauaagaaaaacuuaaccuuuagcagguauuuaguacaaggccuggaacacaggaaguucucuguaaauaugaguuauuauuauuucuagcuauuauuugauccuccucuuuggacaggccagagcaaguuacaaggguaaacauggggccagggauuaaauaguaaggcacagcccaagacuccaaguaauugcaaaaggaggacgugggugaggaggaccaaggagaagaagcagaaaugagaggaggggcuacccagagcagucucuauuaggugcuagcuguguuaugugugucuggguucaaggcagagggugagucaggaagcugaugcugccuauauucaugagccaaaggcagggaauguaaccccgcaguggguucacuuuacccgcugccuagauagagcugauuuaucaagacaggggaauugcaauagagaaagaguaauucacacagagccggcugugugggagacuggaguuuuauuauuacucaaaucagucuccccaagaauuugguggcuggaguuuuuaaggauaauuugguagguagagggccagugaguugggagugcuaauuggucaggucggagaugaaaucauggggaguugaagcuguccuuuugugcuaagacaguuccugggugggggcuacaagaccauaugagccaguuuaucaaucuggguggugccagcugauuuauugagcgcggagucugcaaaauaucucaagcacugaucuuagauuuuauaauagugauuuuauccccaggagcaacuuggggaaguuuagaaacuugcagccuccagcugcgugacuccuaaaacauaauuucucaucuucuagcuaauuuguuaguccuguaaaggcagucuaguccgcaggcaggaagggggguuguuuugggaaaggccuguuaucaucuuuguuucaaagcuaaacuauaaacuaaguuccucccaaaguuagcucagccuacaucuaggauugaacaaggacagcuugaagguuagaagcaagaugguguuaguuagguccgaucucuuucacuguaauaauuuucucaguuauggcuuugcaaaggcaguuucaggaaguuguggccacaaagggcuaguacuuggcauuuuuucaauaaucuacugugcaacaggaccuguguccagcuguggauuuugauuuacauagaaaucagaaccuagacauggaaucaccaguaugaagaauuaaacuugaugcgggcaucugccuucagagacugguauuauuuaucauuucguggccaggauuaagguucuggugaaggggcauuguugucugggguaaauacucgggguuugccgucucacgccaagggaauugaggacgcaaacacaagaaguggguuuaggagcggagguuuaauaggcaaaagaaagagaaaggagaauagcucuuucucuugggagagagagcgggggugcccaaaugggacuucuggcccaugcacauccaugcauggagugcaccggauuuacagacaggcuugagggcccgauuuacauagggccacagacugguuggagcaggugugacguuuacauagccgcccacccuaaucuuauuaugcaaauggcgucuuugccuggccaugccauguugucuucucuuacuguacacguaguuuggcaaagagaugggaagauggagcagccauuuugaacacgccuaguccccagguagccccuuuccuauuggcacaacucccggcacccacccgugcaagcaucucguuugccuuucuaugucugcaggucgauuuuacaggcugcacuuuguuagaaaagaaaaugauuugggggcugcuuuucauuaaaaggaaaaccuuaccgaggacuucauuacccucacuaucugacuaaauaauuucuucuuaacuccuauauauugggagaugagaaauagaauagaggugacagauuagaaaacugacacaaccagaguuggagaaugaccauuaaucccagcacuuugggaggccaaggcagguggaucacgaggucaggagauugagaccauccuggcuaacacagugaaaccccgucucuacuaaaaauacaaaaaaauuagccgggcguggugucaggugccuguagucccagcuacucgggaggcugaggcaggagaauggcgugaacccgggaggcagagcuugcagugagccgagaucgugucacugcacuccagccugggcgacagagcaagacuccaucucaaaaaaaaaagaaaagaaaugaagcauuuccugauaucacaaaugagagcuccguguuaaugacuucuacagccuugcccaguuucaucucuucugcuugcacugacugucaucacccccuacucugcccgucgaagacccacucaggcccuccaucccaagccccucuccaguucuguagcucucaaaaaccuucugucuucccaauucucggggcauuuauacacuacauuauauacguugauguccagcaugagcuaccuugugaaauucacuaaugcuuuuugguaucugucucccuaaauagacugauagcuccuggagagcaaggaucucgugcuuuuccugcuugucacuuguacuguaaagcacaguggugaaagcaugggucuguucuguucacgcuuuuggcugucagucuaaauuuauuguuuugaagugacuuucuuuugcuuauagaacuuucugagguaaagaaagaaucaccaagagaaagaggcguuguuaauucauuuauugaauuuuuuuuuuuagagauaaaucuugcucugucacccuggcuggagaguaguagcuugaucacagcucacugcagccucacauuccugggcuaaagugauccucuagccucagccuccugaauagcuguaacuacaggcacgagccaccaugccugguuaguuuuuaaaaaaaauuuuuuuuguagagauggguucuugcaucuggccucaagcaauccuccugccucagccucccuaagcacugggauuacaggcguaagcuaccacaccuggucccauuuauuaaaaacuuuaaaaagcaauguuaaaucacauauaugcucauuagaaguuaaacaaugcggauguuguauaaaguaaaaguugcuaaccucuugcucugccucaccuuauaaucccacccacucaagguaacacaucaguccuguucuuuauuucucauuuaaaccuuaacauuguccucauuccggaguuuuaagagaaaaagacaggauaaauccugugauuuagaaacauaacagagaaaaauagaauauggaaguuuuccauucaauuaaaguuuucuaaacccacaaagagauaaugcgauuuagcuauugacccagaagcuugcggaucucuuauuuucaaauaauugauuauucuagguuaaugaauuaaaccuaauaauagucagaguccuaagauuaaaaaaaaaaaaaaaagaaaacugguuugggcuggccagauuuggaaauaagucaguuaccugaauaaggcuuuguuguuuaccugucuaacuugcccagaaggcucuucucaucagcaugaugucuuugcuuuguguauucaucugauucagcccagaaucaguaaugaacaacugcaaguucauuucagcaagucagagcuguaaauggcuagaagauaguuacggaauagauagcuuuguauaaagaacaauccagacucuuguuauuuuauuauacagagaauauauuugcuagcagacaaaagcauuauauagcccacaaaauacacuguguugauuauaagaauacuuccagcccauuauucaguccagcaagacuuugaguaaauagauaaaucugugacuguuuguucauucuuccauccaucaaacauucacuagacauagcaaauaaagaaaucagccagacacagccccugcugucaaggaacucagaaucuaguggaggagauagacuaaaaaaucaguggguauagcuauaauagagguucaugcaaguuaccauauaaguacaguagaagaucacagaggaggggaagauaagcugaaugcagagggagucagaacguacaucuggagauggggauaccugagcuaugagucagccagguagccaaggugagaaguagucuagacaaaggguucaacuaaguaguaacaccacaugagauaaaguauguugcauccacguuauuggcuagagugaugguuucuucacuguauuuuucacuuuuaaaucaguucaauuugcaacauaaaggcacagugaaugaauguuacccuacuuaggacaaagucagaugccaaacugaguaaggggugguaggaguagaaggggcaccuguucuauuuaggccuauccguggagaauauugaaagaguuacagauucuuucuuuccaguccuuggccucauccgacccuggagguuuucagguauguguaagcaauugcaggaccuauguaguucauagaucaaauggccuuguagacugucacuaaaauuuuauuugccuuauauuuauacagcuuggauaggauguaccuucaugagggcacucuuggugcgugauugauggcucuucagacaagaugugcuagcuuaauacuggccuuggucaaguaagagaggugcaccugauuugucuugcucuuaaugucaguguucuugcagccuguucugcacacacuguucuucaguguguguaaguuugucucugaacagcaagaauuaccugaaagcaguaggacugccugagaaauggagugaugcuuccaagucuguguguuuauguuuguugcucugaacuggcaggucugagauggacucaaauuaaauuuauagaccccaaggguuucugaggaagaaacaggaacaauuaauuguucauuuuccucuuuuagccuguaaucuaacagugauuuuaggacuaaaauuugauuucagcaagaguauguacauauagaugcuuguucauaacaacucugaaaauguggauuauaugugugauuuuaaugcauucguuggaaauaauauuauuuuucacaaaguaaaagcauccguaauuuugcuacaaggaagaauauuugcuuccucucacacauuuuauuuaauaauuuuacuucuuuaaaagcaaaacagcacacaauuugaaaaugaaauuuccccaaaguguucaguuugcuaauauguuuuucauuuucuucauuaugcuauaauggaauguugccauacuuugaaaugugcaauuuaucucccuggaggcagcagauggugugacuaaucugucuuuugguacaggauuuaucaugagagauggcaucuaggacugcacgaaaugggagcccugcccucaaaaagcagugacucucuuuaucauuauaacauuuagguacacuuuauuauuuuuaaauaugaaaaaacuugcaaaaaugaaaagguuuuagcacuuuaaaaaaacuucauuuuauguaagaaaauauuagguggaaacuauugaguuauuuuaauuauauuugcaaguguuuucuacgcugaaugucucauugcuagaaaacccauuaaccucuugggaaggacaugauuuuguuaggauuuccacccuagucucugcucuacagcuuugaaagccuagcaauucauuuuacauaguaauauugauucacacuguuacuggaaggggaucccgauccagaccccaagagaggguucuuggaucuugcauaggaaagaauucagggugaguccacagaguaaagugaaagcaaguuuauuaagaaaguaaaguaaaggaguaaaagaauagcuaguccauaggaagagcagccucugagggcugcugguuccccauuuucaugguuauuucuagauuauauccuaaaccagggguagauuauucguaaguuuucugggaaaggggugggcaauuuccaguacugaacuuuuucagaccauauaggguaacuucuguacacugccauggcauuuguccacugucacagcacugguaggagugucuuuuagcaugcuaaugcaugagcagugaggaugaccagagauuacuuucaucgccaucuugguuuugauggguuuuggcaggcuucuuuacuacaaccuguuuuaucagcaaggucuugaugaccuguaucuugugccaaccuccuaucucauccugugacuuagaaugccuaacuuacugggaaugcagcccagcaggucucagccuuauuuuacucagacccuauucaagaugcaguugcucugguucaaacaccucugacaacacuaaccaaacuuguagaagacuguuagaaaauuagaguucuguuuuacuaauuuacaggaaaaauacaacuucaaguagaucugguaauucuuucccucucggugaauugccaucagaagccagguuaugauaguaaguuugguuaguaggaauagaccaucccuguguggggcuaugccuaccuuuaggaccuaauucacaugucgugaguugugauguccuuguuccugaacuguccuaagaauuuuuuauucucuggacauuuuuagucuccugcuaacuacuccauuauaucaucucuuaaaauagaagggcuaaugagcacuuaacucccaaacagaaaauaguuuuauauugaguguaaacuccaggagaauagugauuuuucuguagcgcuguaaucaauuagcaaugucugccacagacaagaaaagagaauggugguagcuuaagugacacacauuugcucacccuaguuuaaaucccaccauuaguauauggaaucaaauaaguacucugauuaauauuuaagaacugcauucugcauucuuggaaauuacuugagaacaugguuuuaaagcuggaagaaaucuuaauuuucccauuucaugguuuagaaaacauuuguuuugagggacuuacugaagucagagagcuaauagguaguugagcaauaauucaagcccacggucucugccucaugguccagcacacuuucuuucuuuuauuuauuuuauuuuuauuuuuuuaagagauggaggucucacuauguugaccaggcuagucuugaacuccugaccugaagcaaucaucccaucucggccuccccaaguauuaggauuacaggcgugagccacugcacauggccucagcacacuuucuuauaaaccauaguaauaagucuaagaauuacaaacacugaucauuucauuuuucaacuuaauuugagaaaucacuuuuggcugguaggacugaguauuuuauuauuuuaggucagcaaaauaaacaugaggauuauuauauaaaccuaugguacuuagccuuaguugaacauuagaauaauuugggaagagauuuuuuaaaaugcccaggccucuuaccaaccaauuaaaucagaaucucugggguggggcaacaauuguaguuacuuuaaaaaauuuuccaaugugauuaaaauuugcagccaggauugaaaucauuuauaucacaauuugaaaauuuguucaaaugauugaacacuuugugaaugcuuagucauuguugacauuauucagguaagucuuaaaauaaucaauuuuuuaucagccaaaaucaguccuuccauaagacaucauagaauuacaaauugauuaguaaauugcuaaauaguuuucauuucaugauucuuaguauaggcauggaauauaaaacuagaaaaauagcaaugauugugaugauaaugaagaauuauccuuaguuuaugccaugauagaauaaagaaaaauauuuccuuaaauaguuuugguaaaauguguaaacauaauaauuucagaugaauggaaaccugguggugaauaacugcaccagaauauuaugcaaguacccuuccagcucagggaaaugucugcugauaacagguucagugauacauaguuguguuucauggaucagaaaauggaaauugcuggaauggaaacuuuuguuucuuugcuacccauuuauucauaguacuuagaguuuugugauucuuucugccgcuuaaauauagcuaaacuuugccccauguauguagaggaagagaauauugccccaaauccaaaguaaagaaaaacagguauuuaucuuuaaaaugaauuuuaguauuuauuugaauauuauugauguuuuggaaauucauagugcuucagaaaugaagccauaguauaaaggccuucagggcaagagauuacugucuuccauguuuccuuaacuucccaccacuuugcccuauacuagacuguuuuagccacagaccuuugguuuauccucucuuucaguucccugucucucccuucccaccuuauucucuaguuugcacuuuaagagguuggggagggaauucgugcuuauguuuuaaaagacuuuucaguguguagagcaggauuggggaaaaagcaguugcagugcugccuugcacucaagaaaaagcuguaagaauaccggccaacugaaggcgaggaauuugaaacaagacuuuaaaaugccacaguuugauuaaacauuuauagauaauaaaaacuaaaugacgaucucguuaugaacuaagaccuuccuaguucugaugaagauagauacuguguauagcaaaagagcuggcauuacagaaguccucuuauggcacauaauucagaauuagcauucuuaaaguugauacuacgaaaugucauugaggaaagcuuuuuuuuuuuuuuaauguuacucuuuggauuggcagguuaugacaaaacuacauucauguuacuugaauacgucuuuugucuaguuuuacaugcuuuuugacuugucuagaaaaugacauauugagguuuucauuagcuuuaaccaggugugauuuucuuauggaaguaccauggcaggacugcaguuaaggggaauaaaccagugaagcucagaaaggccauagcccuucuucagaugguagcaaugagcugaaagacucauuaaucaaccgcagagucacaggugugauggcuugccuacaaacugccaacagacugugaaagucacauccaacaggcuaaauugucaaacuagacccauccauaaacauuuuaacacagcaaaauuccgccucuuuugucuuuaagaugugauuuuuaaauauuacauuuccuccaaacuucuauaaaauguuguuuauuuuguuuuauacaacuugaauuucuugaaaaagaaccagauuuggcauuguuuuucuuucauaaaaauuuguauucaucucuauuuuuuauuugauuuuuuucuuaugcuuauuuacucuccuuuauucuaaaaaccuuuucuccugcacuacaugaaaggcuugaggauggaauuuaccucugucaaaguuuuaucaguuggggaaaaaccacuuuuaacguguguuagcuugaguuuuaccacucagaaggauuucauucauaaggaaaugucuguagaugcguuuuaaccgaaggacuguauuguaaucuauuuuuuuuaacgaaaagaaauucucuacuucaaguuaccugugugguucuuugucuuucucuuucuuucgagcucucuaaggauucaacauuguuguauguuuauuuuuuuaaaauuugguacaucacagcugggcgcaguggcucacgccuguaaucccagcacuuugggaggccgaggcugguggaucacgaggucaggagauugagaccauacuggccaacguggugaaacccugucuguacugaaaauacaaaaauuagcugggugugguggugcgcaccuguagucccagcuacucgggaggcugaugcaggagaaucucuugaacccgggaggcggagguugcagugagccaagaucacaccauuguacuccagcgugggcgacagagcgagacuccgucucaaaaaaaaaaaaaaaaagaaaucaaguuaaaccuuaaguuugauguguauuuuugucuggagucccaugacaaaaugaaauuuucaaaugaauauguaguucauguguuuuuuuugucuuuuuguuuuuuuugagacagagucuggcucuguugcccaggcuggaguccgguggcgcaaucucggcucacugcaaguccgccucccgggugcacgccauucuccugccucagccucccgaguagcugggacuacaggcgcccgcgaccacaccaggcuaauuuuuuuuuuuguauuuuuaguagagacgggguuucaccauguuagccaggagggucucgaucuccugaccucgugauccgcccacuucggccucccaaagugcugggauuacaggcaugagccaccgcucccggcuguaguucauguuuuaaggaugauuucagugaaauaguaaaauauauguguaacuccugcaguaacuuguaguuuugcuuuuugcacaacuggaagcuaauaccuaagaccaaaugauuuauauauuuucuaagugaagguucaucuuauuaauuuuuaaaacauugaauaaguacauuggugcucaucaagcagaggaaauagaauuaagcaugaugcaaugauaaauuauuuggguuuucuaggaccuugccccucagagcuucuuccauuggaaaggcagaaucuugggccccacccaagaccuacugaaugaaaaucugcuucccaaccagauacucaagugauucaugugcauauuaagguuugagaagcacugaguuaaagugaguuggacaauucuuuucucuuacuaguuuucaccuacuauuuaaaucucaucccagcaaauaccauuauaaugaaaguucaguuuuaacaaacauaccuaaaccauauuucucuaaauaagcaauaucaaauacaaugaacaccaacuugacaauaguauuaaaacacccuaauaaaauuguuugagaugagauuugaucucuuaaaugcaacuaagugaaccuuaaauacaaggucaaugauauuguaccaaaucaucuauuuaguaagucuacauguaugacccuaguauaagaaaagacagaguguacaaaaaauuguaaggcauaaucuuuuaauaaaaaaacuuacaaaucauauuuuugaggacuaagcucugauuuuuuuauuuugcucaaauuccuaucuaacgggucuggggaaucauggccugcaaaccauaaauucucaucagauggguuuuauuuaacucuauauaucgugacuuacuuuccaaucucacucagcauaacauuacaugacaaagaagaaaauaaaaauauuuuacccccaaacauguuucuuugcuguauuuugaaaagguccugcaaagccguccuuugugggggaaaauuugcaucuguaaagaaccucuauuaacauagcuagaucuuuuucuuccaggcccucccaauccugaagagauuaacugagagccuagcaccucuuaaaggucugaauaggaaacauuugucauccauugucucuaagggcagccacuaugagacaucaaaagaaccuuggccuccacaauuuuuuaucuuaaugugaacauuuccuuucuauuaaucccaggucuuagacaaacucaaacaauugucaaccagaaaauauuuaaauuuaccuauagcguggaagccugccuccaugccccccuucgaauugucccacccuucuggaccaaaccaauguauuucucacauguauucgauugaugucucaugccucccuaaaauauauaaaaacaagcugcaccccaaccaccuugggcacauguucccaggaccuccugagggcugugucaugggccauggucacuucuauuuggcucagaauaaaucucuucaaauauuuuacagaguuugacucuuuucguugagauuuuuauacacuguaagacaguuugauuaugaagcucuaaaauucuuccauggccucaauuuauuuuucauauuuuaagauugaaaaagacagaaacauucuucaaaauagcaggacuugacaaugucccuuaugaaguuuauuaccugaauuaaauguuuuccuucguaggcuauucugauuacagcguaagcuaaauaaaauaugucauguuuucuuauuuuuuuucaaguuauuucucugucccuuggaaaaaauacaaauaaauauuuagacuaaauagacucuggaacaucaaaaaggagauagaaaugacaauuuauacccuuaaggaaguagucauaccuuaauucacauuccuugucaaucucuguuuugccaaaauacuauuaaauuauauauaauaaauuucauaaaauauucugauuacuaauccauauuaaccuuaaauucauauugaaacacuacuuuaaggaaauguuggagagaggaugggagguuaugacaagaaauuaauaggaaguuuaucuguggcccacuuaaugguagcuaaauaaaauugagcaaacucugauauuucuacaauguuguauauggccaauguucuccugggaauucuugguaggaaaguaucaagccgauuuacucuaguuguguacuugcacggagaaagcccucaauaacuacuuauguugauuugaaaacaguugaaagaucaguagcaauacagaaauuuaauagaaagggaaugggaagaaugaacauuguacacugagaauuugcuguauuacuaaaaauuauaucacaucugcaauucuuacuuaacugacuauauuugauggagaacaguaaaaauacuauguaauagauuacaaaguaaauaauaauauaaugauaaagguuaaaacauauauauuuggaauuuugcauuuacauaugauauucuaugcucauauuaaucucaagacauuugauuaucguauccucaucggugucccugcccccgacccuuuugcuguacaucagugcauaacuuuuagcaacuauucuccuguggucaaagacuagaaagagcuaucauuucauggccucauuucacguagaauauauaacagaauuaucagcuucauuuugauggaaauguauauaagaagauauugucauugaaaucaucaaaaaauaugccuugaagugaaucuaauggccauuuauuuuuuaucuauacuguuagugguaaauaauuuucaguuaugcuuuuaacuuaguaauuauauaccccccaaaauaauauggaaauguucccuuuaauugucauaauaaaaacucugagaccugcauuuaaauacaucuagacucuuuccaguaaaguguuaaugaaauuaacaguaaaaagguaucaugaauucuacugggauaauuacauggguaauuuaacaguagauuuggauaaaacuggaagcauuuguaugauacccaguaaaaccucuguaaaugguauguagaaaauugaagacuucauauugucuuuuggauacaaagagaaucuuuuaaaauguuaaguagaaguaguuguuaaaagguaaauuuuugcuuucauuauucuaauaaauaguuuuuuuaaaaaaaguagcuaauuguuguuuccuggcuuuauuguccuuuugaacuuuuaucuuuuugacaauguuuccuguaagauuuuuauuuauuuuauuuuuauuuuuccauaaguuauugggguacagguguauuugguuacaugaguaaguucuuuagcagugauuugugagauuuuggugcacgcaucacccaagcaguaugcacugcaccauauuuguagucuuguagcccucaccccccucccacucuuccccccaaguccccaaaguccauugcaucauucuuaugccuucgcauccucauagcuuagcucccacauaucagggagaacauaccauguuugguuuucuauuccugaguuacuucacuuagaauaauagucuccaaucucauccaggucacugcaaaugcuguuaauucauuccuuuuuauggcugcauaguauuucaucguauguauauauguauacuacaguuucuuuauccacucauugauugaugggcauuuggguuggcuccaugauuuugcaauugugaauugugcggcuauaaacaugcgugugcaagugucuuuuucgaauaaugacuuuuuucccucuggguagauauacaguagugggauugcuggaucaaaugguaguccuacuuuuaguucuuuaaggaaucuccacacuguuuuccauaguagcuguacuaguuuacauucccaccagcaguguagaaguguucccuguucacugcauccaugccagcaucuacuguuuuuugauuuuuuuauuauagucauucuugcaggagugagguggaaucacauugugguuuugauuuguauuucccugaucauuagugaugcugagcauuuucucauauguuuguuggccauuuguagaucuucuuuugaggauugucuguuuauguccuuagcccgcuuuuugaugggauuguuuguuuuguucuugcugauuuguuugaguucuuuguaaauucuggauaugaguccuuugucagauguauagauugugaagauuuccucccacucuguggguugucuguuugcuguuucuuuugccaugcaaaagcucuuuaguuuaauuaagucccagcuauuuaucuuuguuuuuauugcauuugcuuuuggguucuugaucaugaaauccuugccuaagccaguguccagaaggguuuuuuccaauguuaucuucuagaauuuuuauagucucagaucuuagguuuaugugcuuaauccaucuugaguugauuuuuguauaaggugagagaugagaauccaguuucauucuccuacauguggcuagccaauuaucccagcaccauuuauugaaaaggguguccuuuccccacuucauauuuuuguuugcuuugucgaaaaucaguuggcuuuauuucuggguuauuuauucuguuccauugggcuaugugccuauuuuuguaccaguaccaugcuguuuugaugacuauggccuucuaguauaguuugaaaucagguagugugaugccuccagauuaguucuuuuugguuaguuuugcuuuggcuaugcaggcucuuuuaggguuccauaugaauuuuagaauuguuuuuucuaauucugugaagaaugauggugguauuuugauguggauugcauugaauuuggagauuucuuuuggcaguauagucacuuucacaaaauugauucuacccaucuaugagcaugggauguguuuccauuuguucaugucaucuauuauuucuuucagcaguguuucguaguuuuccuuguagaggucuuucaacucccugguuagguguauuccuaagugguguuuuuuguuguuguuguuguuguuuuuucagcuauuguaaaagugguugaguuguugaucugauucuccacuuggucacugcugguguauagaagagcuacuaauuuguguacauuaaucuuguauccagaaacuuugcugaacucuuuuaucagcucuaggagcuuucuggaggaguccuuaggguuuucaagguaaauaauccuaucaucagcaaacugaugugacuguuugaccuccucuuaaccaauuuggaugcccuuuauuucuuucucuugucuggauugcucuggcuaggacuuccaguacuacauugaagaggagugguaagagugggcauccuucaggaggcugaggcaggagaaucacuugaaucugggaggcagagguugcagugagccaggaucaugccauugcacuccagcgugggcaacaagagcgagacuccaucuccaaaaaaaaaaaaaaaagaguggacauccuugucuuguuccaguucucagagggaaugcuuucuacuuuuccccauucaguauuauguuggcuguggguuugucauagauggcuuuuauuacauuaagguaugucccuuguaugcugauuuugcugagaguuuuaaucguaaaagaugcuggauuuugucaaaugcuguuucugcaucuauuaagaugaucauaugauuacuguuuuuaauucuguuuauguugugucacauuuaucgacuuguguauguuaaaccaucccugcaucccugguaugaaacccacuugaucaugguggauuaucuuuuugauauguuguuggauucgguuagcuaauauuuuguuaaagauuuuagcauccauguucaucaaggauaucagucuguaguuuucuuuuuugguuauguccuuuccugguuucaguauuagggugaugcuggcuucauagaaugaaucagggaggguuccuucuuccccuaucuuguggaauagugucaaaaggauugguaccaauucuucuuugaauaucugauagaauucugcugugaaucugucugguccuagacuuuuuuuuguugauaauuuuuaaauuacuauuucaaucucgcugcucguuaucggucuguucagaguaucucauucuuccugauuuaagcuaggaggguuguauuuuuuccaggaauuuauccaucucuucuagguuuccuaguuuaugugcauaaagguguucauaguagccuugaaugaucuuuuguauuucaguggugucaguuguaauaucuccuguuucguuucuuagugagguuauuuggauuuucucucuucuuuucuugguuaaucuugccaguggucuaucuauuuuauuuaucuuuucaaagaaccagcuuuuuguuucauuaucuuuuguauuucuuuguuccaguuucauuuaguucugcucugaucuugguuauuuccuuuuucugcuggguuuggguuugguuuguucuuguuucucuaguuccuugaggugugaccuuggagugucaguuuuuacucuuucagucuuuuugauguaggcguuuagggcuacgaacuuuccucuuagcacugccuuugcuauagccuagagguuuugauagguuaugucauuauugucauucaguucgaagaauuuuaaaauuuccaucuugauuuuguuuuugacccagugcucauucaggagcagguuauuuaauuuccguguauuugcaugguuuugaaguuuccuuuuggaguugauuuccaguuuuauuccacuguggucuaagagaguacuugauaugauuucaauuuucuuaaauuuauugaggcucguuuuauggcuuaucauauggucuaucuuggagaaaguuccauguacuguugaauagaauguguauuaugugguugcuggaugaaauauucuguauauaucuguuaaguccauuuguuccaagguauuguuucuuuguugacuuuccgucuugaugaccuguccagugcugucagugcaguacugaagucccucacuguuuuuguguugcugucuaucucauuucuuagguccauuaguaauuguuuuauaaauuugggagcuaugguguuaggugcauauauauuuaggauugugauauuuuccuguuggacaaggccuuuuaccauuacauaaugucccuuuuugucucuuuuaacugcugcugcuuuaaaguuuguuuuguuugauauaagaauagccaccccugcuugcuuuugguguccauuugcaugaaaugccuuuuuccacccauuuaaguuuaugugaguccuuaugugcuaggugagucuccuaaagacagcagauaguugguuggugaguucuuauccauucugcaguucugugucuuuuaaauggagcauuuaggucauuuacauucaauguuaguguugaaaugugagguaccauugcauuccucaugcucuauguugccuguguacuucggauuuuauuuuugcuuuuuaacuuguauuuuuguuuuauagguccugugugauuuaagcuuuaaaaagguucuguuuugauguguuuccaggauuuguuucaagauuuagagcuccuuuuagcaguucuucuagugguggcuugguaauggcaaauucugucagcauuuguucucugaaaaagugcuuuaacuccugcugcuuuaaaguuuguuuuguuugauauaggaauagcuaccccuggucacuuuugguguccauuugcaugaaaugccuuuuuucacccauuuucuuuaaguuucugugaguccuaugugcuaggugagucuccuuuccuuccuguaugaugcuuaguuuugcuggauacaaaauucuuggcugagaauuguuuuguuugaggaggcugaagauagggccccagucccuucuagcuugcaggguuucugcugagaaaucugcuauuaaucggauagguuuuuccuuuaaagguuaccuagugcuuccguaucauagcucuuaagauucuuuccuuccucuuaacuuuggauaaccugaugacaguguaccuaggugaagaucuauuggugaugaauuuccaggguguucuuugugcuucuuguauuuggaugucuagguuucucacaaggucagggaaguuuuccuuaauuauuucccgaaauacguuuuccaaacuuuuagaauucucuucuuccucaggaacacugauuauucuuagguuuggucauuuaacauaaucccagauuuauuggaggcuuuguucauauuuucuuauucuuuuuucuuugucuuuguuggauuggguuaauuucaagaccuugucuucgagcucugaauuucuuucuucuacuucuuuaauucuauugcugagacuuuccagagcauuuugcauuucuaaacauauguccaaccuuuccugaauuuuugauuguuuugucuuuaagcuaucaauuuucuugaauauuucucacuucauuucuuguaucauauuuuggauuuccuugcacugggcuuugccuuucuuuggucccucccugauuagcuuaauaacuaaucuccugaauucuuuuucagguaaaucaaggauuucuucuugguuuggauccauugcuggugaacuagugugauuuuugggaguuguugaacagccuuguuuugucauauuaccagaguugguuuucucauuuggauaggcucuuuuagagggaaggucuagggcugaaggauguuguucaguuucuuuggucccacaggguauucccuugauguaguacucucucccuuuuccuauggauguggcuuccugugagccaaacugcagugauuguugucucucuucugagucuagccacccagcgagucuucccagcaccaagcuguacuggggguugacugcacagaguccugugaugugaacugucuaugggucucucagcuguggauaccagugccuguuccgguggaaguggcagggggugcaaugaacuccgugaggguuuuuagcuuuggugauuuaauguucuauuuuuguacuggucggcauccugccaggagguggcacuuuccagagagcaucagcugugguauuacggggaggaaccagcagugggcggagcccuagaacucccgauuauaugcccuuuucugcuacuaggguggguagggaaggaccaucaugugggggcagggccaagugugucugagcugagacucuucuuaggugggucuuaccgaggcugcugugggaaugaaagugagauucccaggucacuggaguuguauaccuaggaagauuauggcugccucugccaagucaugcagguugucagggaaguggggaaaagcuggcaaucacaggccucacccagcucccaaauaaacugaagggccagucucacucccaucaugacccgacaacagcccccagaccuuuuccaggcagagucauacaggcuugaaaaccugccccaggcuaucugccuccaaguuguggaaaaaaaagggcuugguucgucccccaccuguggaguacgcacgcuggauuugugcccucccccaaguucuggccaggagacuucuugcccuguucaaacuguuacgaaguucagcuagagauuugcuucucccuguauaauuuuaaucccugcuucucucccguuggaucccuguggugccaggcaggaauggcccgcuaggggacccaacaagcucccagggccuuucugcugcuucgucuaccccuguauuucgcucggcucuccaaauagacucagcuccagguaaagucgcaaacuucucccacaagcagaccuucaguuucuccaguggcgguguguguuugggaggggagggucuucuuuuccuacuucugcaguuggggcacucacaguuuuggggaugucuccuggguccugcaggagcagucugcuuccuuuggagggucugugaauccucucgggauugcugguuuguucuugcagucgaucuggaaaaucauuaucuuaaaauucugugcuuuuaauauauaguacuuaauauaauuuuauaccccacaacaaaguuauaaauccauucugcuuguuaucuaauuugaucaauuaacauaagaaaauaaacuauaacuucccucaaaugacuuaauuuggggcaguacuuuguagcugguuuccacucaggaauauucuugacuauugaaugauaguaagggaggagaccaccccucauauugucuuaucccaauuucugccuccaaagaaagaagaaguaaaaacuaaaaggcagaaaugaaauccacaggcagacagcccggugccacacccugggccugguauuuaaagaucgaccccugacuaaucaguuauguuaucuauagauuacagacauuguauggaaaagcauugugaaaaucccugcccuguucuguucuguucuaauuaccggugcaugcagcccccagucacguacccccugcuugcucaaugaucacaacccucucauguggacccccuuagagguguaagcccuuaagagggacaggaauugcucacucggagagcucgguuuuuggagacaugagucuugucgaagcucccggcugaauaaagcccuuccuucuuuaacuuggugucugagggguuuugucugcagcuuguccugcuacaauagcagauuaaaaaaaucugaagaaauuuauuuucuaaagggaagaaaauagaaccuaauauguuuagagcuuuuguuauucaucugauaauaugcuguauauuuauccauaaacuuuuaauccugaaaauuauucuauaaaacauuugucauauucucaauuauaaagaugagaaaauaguuucaaagaaagaauuuucagugucacacacuuuacacauagccaaguugagauucaagucuaaggcugacaguugacuccaaagccacaagcccacauccuuuucaauacagacugcuugcaaaauacaaguuguaaugacaugugacauggauauuuuucuuucuaggaacauguauguuccuaggaacauaacauauauguuauuuuuaaagauuuuauugugaaguauaucaagcaguagugacacaaaacuuaaaugugaagcuuuauaaaguaucauaaggcaaacguucauuuaaacaccacugauaaccuaugcccaggaauagaauauugccagcacccuugaaguuccccacccucaccacgcucuuucugaacaccauccucuucuuucuccuauaagauuacuacuaucuuuacuucuaacauuauaguccagacuuuuuuuuuuaugguaacguauacauaaaauguaccauuuaaccauuuuaaacuguauaguucagcagcauuaaguauauucacauuguuguauaaucacuaccaccauccaucuucagaauuuuucaucuuuucaaacugaaacuguacccauuaucaauaacucccauuccucucuucucccagccccuagcaaccaccaugcuauuuuccgucacugaauuugaccacucuagguaccccauguaaguggaaucauacaauauuaauccuucugugacugggcauauuucuuucagcaugauaucuucaagguacauccauguuguagcaccugccaggguuuccuuccuuuuaaaggccaaacaauauugcauuguauguauguaccauauuuguuuaucuaguuaucuaucaauguacaacuuguacaacuuugguugcuucuaccuuuggucuauuaugaagaauauugccaugaacauggaugaacaaauagcuguuucaguccuugcucucagucguuuggguuauauaccuagaaacaaaauugcuggauuauaugcuuaauuuuuugaagaacugccauauuguuuuccauagcagcuguacuauuuuacauuaucauuagcagugcacaaguguucuaacuuauccagauccuugccaacaauuguuauuuuuguguuuucauuguagauuuguucuuuuugaaaacuuuacauacaugaaauaaugcauauuuucuucuuauucuggcuuuuuuuugcucaguuugcgagauucuugcaugcaguugaauauagaugaagcuguauauuuuuuauuacuguguaguauuccauguaugacaacaucaauuuauuaccuacuccacuguugaugaauauuuggauuguucuaguucuuaguuauuaugaauaaugcugggaacauugauauacaugaaccuugggguaugugugagcaauuuguuuuuauauaccuagaaguagaauuucuggaucacaggguaggcauauguucaacauuagauugugccaagcuauuuuccaaaguuguuuuacuaguuuacauuuccgccagaaauuuguagaguucucacugcaucauauccuuccuagugcaaaugugcuuuucaccauucuaauaauuacugaugauguggaacauuuuuguuuuuacauauuuauugagcauuuggauagucucuuucauaaaaugucuuuaagccuccugccuauuuuuucuauggauucuuuugucuuuauugauuugcaugcaaaaauauugauaagauggauggaaggguagauagauagagggauacaaacuuuuuguugcaaaugucuucuauuucuuggcuugccuuuucacuuucuuuuuuuguuuuuguuuuuggagaugcagucuugcucuguugcccaggcuagagugcaguggcaccaucucggcucacugcaagcucugcuucccggguucacgccauucuccugccucagccuccccaguagcugggacuacaggcgcccgccacuaggcccggcuaauuuuuuguguuuuuaguagagacuggguuucacuguguuagccagauggucucuaccuccugaccucaugauccacccaccucugccucccaaagugcugggauuacaggugugagccaccacaccuggccuccuuuucaccuucuuaaugaugucuuugguaaauagaagauuuuaaugucaauguaguaaagauuuauaagacaaccuuccuuuauggaugaugguucuucugcccuuuuaaauaaaccuuucccuaccccaaagucaugaagauauuuuaaauuagcugucaacauauucaaaaaaagguggaaggcugcugagaauuucagugaauuuacauuauauguauagaugaauuuguagauaauugauaccuucauaagauaucaauugaucuuggcuuggucuuccaagcuaugaacauuguauuuccuccaugggucuuuaauuuuucuuacuguucucuuguuuucugcaaagguauguuguccaucuuguauuagaauuuauuuuuaaguauuugauauacucaaugcuauuauaaauguuauauauuuauaagcuuuuguuuucucuuuuuugguacacagaaaugaagagauuauugauacugagucuuugcucaacucacuuauucuaguaauuuuacuagaacauuuuuugacaucuacucaaaucauuuaauugaaaaaauaucuuaaugcauucauuuuuaauuauuagcacauuuuuaauaugauuuuuuucuuacuuuauugccuugguuaacagcuuuaauauaguauuaaauugacaugguggucauaaugagcauccuucugucauccuaaucucaaagaagaaagccuacuugaaauucuuccuuaauuucuauaaauaaugaaacaucaggguaaacuuuuggacaauuuuuguuuuauaacuucaacucauuaacaaugauaugguauauggagagauuacauuuuaucuaaaacuacccucaguucuuacuuaucaaagccucugugucacugacuuuucuaaaaaucaaaauccuuaaaauugaauccucugaauuuuagacaucucaccugauauuuugauacugacuuccaaauuuauauaugugacauuauuccuuucauuuuacaacaacuguuuaaaaaugugguuugguguauauucugcaguaaccucacaaauucuuguuaauuaauuuaacaguauguuauuugaagaaaaagauacacuugacuguuucaauauauuuuacuagcuguaucucuauuacuaaaaaaauuuuuuuuagugagacaauuuuggugcaaauccuucagguuguucuuuuuuuuuuuugagacggagucuggcucugucacccaggcuggagugcaguggugcggucucggcacacugcaagcuccgccucccagguucaugccauucuccugccucagccucccaaguagcugggacuacaggcgccugccaccacgcccggcuaacuucuuuuuguauuuuuaguagagacgggguuucaccacguuggccaggauggucucgaucuccugaccucaugacccgccugccuuggccucccaaagugcugggauuacagacaugagccaccgcgucuggccgagauugcucuuaaucugagaugaggggagucuuuauuucccucaguauaguauauauauuuuugaucacucaaaugccccauuauuccagauuauugaaauaaauaauuacagcugucauuuugguuuaaugugacaaugaaaauaacuguaagagauaaaucucccuuuuuuuuuauuucacuagauugaaaaagcaauccauguacuuuucauugaccucucuucaccucucuuaaucaagacauuucugucuaaaauaauauuuggaaaaggauaggcauaaagagagcugcaugaaaaugcuaacacaucuucaguuucacucuuucauuaauggccaugcucuuccuuuugcuauuaucuauggacucagcccuccauccuaccucgaacccucauugcugugacaaaugaucaauuccgugauucagauucguugagaucagcuagguguacuccaugauaaugaugaugauggaugaugaugaaagagauagcagcgaugaugaugcuggguagcuaauuuguagaaccuuugaauagaugugccaucccacaugacagcagaaagugugacgguuuuguuaggcauccauuuuauaagacagaggauuuuagcaaguucuuauaugggaauuuuaaacaaaacucucugucugauaugaagaaauguggcacuucacauauuuuuaaacucugcuuacauaguauauuagaagaaacauuuuucauauuuuuucuauaaacaucauuuaucuaacaauuaaaguaauaucaucuguuuuauuacacagauauuauuuuaugcuugaaacuuuuacuuuuugaagcugaauauuauuaacaggcuuuccuucaccaacacaaagaaacaucuuugagagacagaauaccacacuaaaaucaucagggacccauccguggauuuaugcuuagaaagaauggaagguaaauauguaggucuaugaagaccauguucuuucuccuacugaauuaauacaucucaggccucuucccagcacugcguuaugcauuuuuugggugaauaauugaaugauuuuaauuuugcaagcuauaaaauuuuauuauauuuuacuuuuucuccacuacaaccugacuccaucaaggagcucaacugauguuuaugcuugauacuucaaguuagacagguauagcuugcugugcuuuuuaaagaguagcuaacauauguaucauguaacauauguaucaugagcuuuuucacauaaugucagacuaauuaauguauuauauuucacugcaacaggaucacauuagucuugauaacuuaaucauucagacuggucuauugucuuccaccaugaacuuaaaaugauguaaguauacuuagaugcacugaauugugaaaaauauaaaauacguaugaauaugaacauuuuaaauugugaaccaaaauuugucuucauuuuguauaaauaacucagguagguaaccauuaaaguacgguucuuccucuguauccuuggauucuguauccaaggauucaauuaaccucagauugaaaauauucccccccaaaaaauggaugguuugugucuguacuaaacauguaccgacuuuuuucaggucauuauuuccuaaacaauacagcauaacaacuauuuucauagcacuuacauuguauuagguauuauaagaacucuagagaugauuuaaaguauaugggaagauguguguagauuagagcaucuggagcaccuaugcauuuugguauccaagaggauccuggaaccaaucccccauggauaucaaaaaacaacuguauagguuaaaaacacagcauauguuaacucaaccaaacauuuuauuuaucauaucaaggagaauaugaauaguauuuuucagugcacaugggaaaacuucuagacacucuucaaaaaugauuucuuuuaagaggaaugcuuucuuuaacccauaauugaagaaaguaagauugguacuuuuagaguucacugaugaaaauggggauauauuuuagauugcuuuuuaaguuuauaagguagauuuaguaauuuuaaauaaauauuuggccuguuucuuaaagaacaggacaagucuuaugcuaccaaauucaacuaccaugcuaaaugagauucaauacauguccuaauuguauaagguuuguguuuggacacaaaaaaugugggccaaacugacugaguugauguauaauuauaagucuacaugaaaaaugcaauuacgaguaguuccauggaauuggaaacugugcuuucucacauugucucccgagugccuggugagacaucaggcuugguggugguggagaaauacguguugaaugaauguaugagaggaagcauuuagaauaaaaaugcguugacgcuacaggaacuaagacauaagauauucaauacgguucaccacugaguucuaaaaaacaauguuuuucuacuuugauuuuuaaaagaaccacaacucccaagucaaugagaaaaagcuucuguaaaucagccacuaaagucuuauuaaaucacaaauaccaaagauguaaaaaucuaucuacaauuuuuagcaacucaucauacuaaaacucaucugggaagaaaauauucauaggaauuaaagugcuuuauuuauaagaggcacaauuaagauggaugcucauuuuuagugauuaguauacuacccccuaguuaauagaauccucuagcuuuccccagaagaugagggugagcuagugcauuuagaagaaaaugguaccugucuacaucuacgaacagcuuauuuugcagagcgguauaaaacaaguucaauuuugguauguaaaaaagcauuauuaauauuuuuaaggaagaagaaagaaauaugugaaaaaaugauuacaaauauauguuaaauuauaagguuugaugucuuuauauaaggcaaauguaacaauuugaauaguauuuauuuauuuaauaaucuguuaaaaauuaaugggccauuauagucuuuauuauuguaauagagaaaaggacuuuccuauuucauauuuguucaguauguaauaaaucuauuggauuuuuaaauguguuuauacacauauauaaucacucauugcuuauugcugagaaauguguaauuaggcaauuuuguuuugcaaacaucauagugcguaucuauaaaccuagaugguauaugccuauuauauaccuaggcuauaugauauagucuguugcuccuaggcuacaaaccuguacagcaugugucuguacuggaauacuguaggcaauuguaacaaagugguauuuguguguccaaacauaacuaaacaguacaguaaagauauguuauuauaauagaaaaaguacaguaaaaauauguuauuauaaucuuacaagaccaaugucuucuauguaguucauuauugacugaaauaccauuauguggcacauguggcaccauauauaguauacacacacacccacacauacacacauaaaguaaaugaaaaggagaaaucagagccuggcauuuuauccuauaaccuaagcagagucaaaacgacuacauuuuacuuaaaaaaggauucuuuucccacauaauuaacauuuagcuaucuauccugacucaaggagauacagucaugaaaagcccaaaauacuguagcauauauacugcauaaaaaauacuguuagauuuucuuauuguaacauuaaacauaauuccucaauucaauucaaccuucaauggagagaauuaucccagcuuaauggagagaauuaucacucaucugguugaauaagcugggaaccuggguguuguacugaaccagucuuucauucaugcaccccauuuccaauccaucauauauccauuuauuucucucucuccaaccauuccacuucugguuucauuuucaccacuuuaguguaagguaccaucaucuccuaugcagauuacuucaggagcucguaacuggccucuguucuucugucuacccagguccuauccagucucugcaagaacaaaucuaauuauguuauucucuugcuuuaaaagucuucaaaagcacuuagaaugaaaucucaaccugaaaucuggccuacaacuccugcaugagcugcccugccuguagcuccagucugauuucauuccucacucacuguagguaacuucuuaugccccagccugucauggccuucuuucaguucuggaaauggucuauucucuuucccacuuuggugccuguguaugucccugcucucuagacuauuccucagauacaccaacccucuucauuuaaguucucaucaacuuuaauaauaauucaaugcuaaauuauaauccauauaguaaagaguaaaugugcucaucuccagauuuaaucaauaauuauaaauuacagaacuaacuugauaagcucuuuaaaaagugucaaagaauaauaaauguaaacaauagagaaacgauaguauauguaaaugaagaauuaaccuaggauuuaugagugguaggguaagaacaaaggaagaauuauacacauuuauuugaauaaaaccaaauagcugaagaaagaucugaauggacaaauuacaaaauucacacaaguuccaagcaagaaucaugaaauaagauccauaccaauacgcugaauucuuaaaacaacuuuacugugguauaauuuauauaccauaaaacuuagcuaugugaauauacaaucucauuuuuuuucuaaauuuauaguuuccaucaccccaaaauguuucuuuauacaaaucugcagucgauccuugcucccacccucagcccuaaagaaccacggaucugcucuggacauuucauauauaaagaaucauaugauaucuauuuuauacuuguacucugugguaauguuuuugaggcacauguaucaguuuaaguaguuucuuguuauugcugacuaguauucaauucuuuuaaauguauugauacuuauuuaauggccuagcauaugauccauauuggagaauguuccauuuuugcuugaaaagaauguguauucucuguuggugggaguguaaauuaguuccgccauuguggaagacaguguggugauuccucaaaaaucuagaacuagaaauaccauuuggcccagcaaucucauuacuggguauauacccaaaggauuauaaaucauucuccuauaaagacacaugaacacguaugcuuacugcggcacuauucacaacagcaaagacuuggaaccaacccaaauguccaucaaugauagacuagauaaagaaaauguggcacauauacaccauggaauacuaugcagccauaaaaaaggaugaguucuuguccuuugcagggacauggaugaagcuggaaaccaucauucucagcagacuaacacaggaacggaaaaccaaacacugcauguucucacucauaagugagaguugaacaaugagaacacauggacacaaggaggggaacauuacacacuagggccuguuugggggguggggggcuaggggagggauagcauuaggagaaauauguaauguagaugacggguugaugggugcagcaaaccaccauggcauguguauaucuauguaacaaaacaugcacauucugcacauguaucccagaacuuaaaguauaaaaaaaaaaaaaagaaagaaaagaauguguauuguacuaucauugggugcucacuucuauagcuauuaguagagacaggguuucaccaugucggcuaggcuggucucaaacuccugaccucaggugauccacccgccucagccucccuaagugcucagauuacaggugugagccacugugccuggcugcaaugauuuaugaaaccaguguaaccuugacacuaaauccuaaugaagauaauucuccuggaaacuguagacaauuauaaaugagaauauacuaagccauauaugagcaaaucaaauuugacacaacauuauggaacaaugcaaugcaauuaacuuagcuuuaucuuaaaaaguuagugauuauuuaaaauauuauggcagucuggcagggucaaauuaaaaagccaugugauaauuuuaguaagugacucaauaauauuaauacacuuccugauaaaaauucuuaguuaucuaaaacugagguggauauuccuuuaacuuaaucucaaccuaaucauuuucaucauaaucaauaugguaagagcuaaucuuauuaaaaugggaauaggauaaaugcuugauauaaucaauuauuauuucauauuauuauuuagguuuuaacucuugugguaagagaggaaauauguguaaguaguauaauuuggggagaaaaugauauacuaugauaauuauuuccaauaugauauuuuuacauauaaaauuaaugugagaaacagaauuaaagagagaucaguuauaaagccaguuuaaaaauaauuguacaaaauuaauauuuucuuuauaugguggcaauacacugaaaauaugagaaauaacaguaacaucacuaauccaagaucacuugguacacucuaugagaaauauacauaaucuauauuaagaaaaauguaagauuagacugaaacaaaagauaauaaaugaagacauauagcauguuccaaaguaggaaaauugaauaucauaaagauguuauuuuuccaaacuuaauuucuaguuuuacugcaauuucucuccaaaccucuacugaacuuugggggacaguaaagugagaaacuugaugacuaauucuaaauucauauugaggaguaaauaacaauagcuauuuuuauuuuagaagauaaguaaugaggggguaaucgaacaaccagauauuaaacacauaaaaaaaucugcaauaguugaaaguauagaauucauucaagaauugacaaaugaacagaacaaauccugguuuuauucaguuuaauaucuguguaagucccugagacuuugaaguuguuacagcaucauaauuugguguaucaugauacaccuucuguuuucugugagauaggauccuguauuuuaaacagaauuacaugccaaaauuaaagcauguugcucuucugaguuugaagaucucaccaaauggagagugacuuuccauuaccaugauaaagcuagacuuuaaaaaguaguuuguggccggguguggugacucacaccuguaaucccagcaguuugggaggcugaggugggcaaauuguuugaggucaggaguucaauaccaaccgggccaacauggugaaacccugucucuacgaaaaauacaaaaaauuagcugggcaugguggcccaugccuguaguccuagcuacucaggaggcugaggcaggagaaucacuugaaccugggagucggagguugcagugagccgagauugcaccacugcaauucagccugagcaacagaaugagacuucgucucaaaaaaauaaaaaaauuaaaaaaauuaaaagucgguugugaaaucuuuauucuaccuuuuuucuucugggaccaauaggaaauuuguuuauuggaagguaaccaguguuuagcauaacuauuuggacuucuucuguugaacuaugugauauguuuugcauaggcaaucauaucaucuacaaauagauguuucaguuuuuccuuuacacuauuuaugucuuucauaucuucuacuugucuuacugcacuggcugagacuuucuguaucguguugaacaggaguagcgaaggcagacaacuuuuuuuauuccugauguuaaaaagcauaguuuauggucuuucaccauuaacuauuaucauuaaucguaauuuuuuuguagaugcacuuuaucagguuaagaaaguuccuucuaauucugugaagaaagucaaugguagcuugaugggaacagcauugaauguauaaauuacuuugggcaguagggccauuuucaugauauugauucuuccuauccaugagcauggaauguuucuccauuuguuuguguccucucguauuuccuugagcagugguuuguaguuuuccuugaagaaguccuucaaaucccuuguuaaguuguauuccuagguauuuuauucucuuuguagcaauugugaauggaaguucacucaugauuuggcucucugugugucuguuauugguguagaggaaugcuuaugauuuuugcacauugauuuuguauccugagacuuugcugaaguugcuuaucaguguaaggaccaaaaaagauccuguauagccaagacaauccuaagcaaaaagaacaaagcuagaggcaucacauuaccugacuucaaacuauacuacaaggcuacaguaaccaagacagcaugguccugguaccaaaacagauguauagacaaauggaacagaacagaggccucagaaauaacaccacacaucuacaaccaucugaucuuugacaaaccugacaaaaacaagcaauggguuaaggauucccuauuuaauaaagauguugggaaaacuggcuagcuauaugcaaaaaaaccgauacugaaccccuuccuuaaaccuuauacaaaaauuaacucaagauggauuaaagguuuaaacacaagaccuaaaacgagaaaaacccuagaagaaaaccuaggcaauaccauucaggacauaggcaugggcaaagacuucaugacuaaaacaccaaaaacaauugcaacaaaagccacaauugacaaaugggaucuaauuaaacuaaagaguuucugcacagcaaaagaaacugucaucagggagagcagacaaccuacaaaaugggagaaaauuuuuccaaucuauucaucugacaaagggcuaauauccagaaucuacaaggaucuuaaacaaauuaacaagauaaaaagaaacaaccccaugaaaaagcgggugaaggauaugaacagaugcuuuucaaaagaagacauuuaugcagccaauaaacauaugaaaaaaagcucaucaucacuggucauuagagaaaugcaaaucaaaaccacaaugagauaccaucucaugccaguuagaauggcaguuuucaaaaaggaaacaacaaaugcuggagaggauguggagaaacaggagugcuuuuacacuguuggugggaguguaaauuaguucaaccaauauggaagauauuguggcaauuacucaaggaucuagaacuagaaauaucauuugacccagcaaucccauuacugaguauauacccaaaggauuauaaaucauucuaaucauguaaaaagacacaugcacacguauguuucuugcagcacuauucacaauagcaaagacuuggaaccaacccaaaugcccaccaaugauagacuggguaaagaaaauguggcacauauacaacauggaauucuaugcagccauaaaaaggaaugaguuaaugucuuugcagggacauggauaaagguggaaaccaucauucucagcaaacuaacacaggaacagaaaaccaaacaccgcauuuucucgcucauaaguggaaguugaacaaugagaacauaugggcacagcgagggaaaugucacacaccagggccuaucgggggugguggcaaggggagggauagcauuaggagaaauaccuaauguagaugacguguugauggguguagcaaaccaccauggcacguguauaccuauguaacaaaccugcauguuuugcacaugcaucccagaacuuaaaguauaauuuaaaaaaaaaaagaaagaaaagaaaagaaagaaaauuccuucuauuucugauuuucuuuucuuuuuuuuuuuuuuuuuugagauggagucucagucugucgcccaggcuggagugcaguggcauaaucuuggcucacugcaaacucugccuccagguucaagugauucucuugccucagccucccaaguagcugggauuauaggcacacaccccugugccuggguaauuuuuguauuuuuaguagagaugggguuucaccauguuggccaggcuggucucgaacuccugaccucaggugauccacccaccuaagguccacccaccucagccucccaaagugcugggauuacaggugugagccaccaugcccagccauguuucugauuuucuguguguguuuauuguuuuuaaugaauugauguugaauuuugucaaguuguuuuucugcaucaauugauaggaucuugcaguuuuucuuuuuuucacuuguuaauauaaugaguuauauuaauugauuuucaaaguugaacuauacuuguauuccugggauaagcuccacuugauuuguuuguuaauauuuuguugaggauuuuucuguugauguucaugaaagauaccugcauguagcuuucuuauaaugucuucgucugguuuuaauacucaggcaaagcaggguuugcagaguaaauuguuucuucguuaauuuccaggaagagauuacauagaaauggcauuauuucuacuuagacgcuuggaauaauuuaccagugaaaccauuugggacuaaaguuuucuuucuggaagauuuuaaacuaugaauuaauuuucucugagagcuauauaccuauucuuguuaucuauuacuucuugaaugaguuguuucgaggaauugguucauuucaucuuaauggucaaauugaugugcacagaguucuucaugaaaaggaguaguccuuuauuaucccuuuaaugcuucuagagucuauagugauaucccuccuuuuccuuguuuucuuucuuuucuuucuuucucuuuccuuccuuccuuccuuucuucucuucuucuuucuuucucucucucucucuuucuuucuuuuuuuuuuugagacagagucucacucuuuugcccagacuggaaugcaguggcaugaucuuggacugcaacuucugccucccagguuccagcgauucuccugccucaccauccugaguagcuaggauuacaggagcccaccaccacgucuggcuaauuauuuuuguauuucuaguagagaugggguuucacaauguuggccaggguguucuugaacuccugagcucaggugauuugucugccucagccucccaaagugcugggauuacaggugugaccuacagugcuuggccccucauuucauuucugauaguaguaaguugugucuucucucucucuuuugaggggaagggaagaaagucugaaaagguugaucaauuuaagcaacccuuuuaaagaacugacuuuugauuucauugauuuuucucuauuuuguuuuuaguuuuauugguuucuauucuuuucauuauuuauuuugcugugcuuuuuucuaauuucuuauaucauaaucuuagaugauugguuugagaucuuuucucuuuucaacuucaagcauuuaauguuauaaauuucccugcacugcuuuaauggcaucucacaaauuuugauauguuguuuuucauuuuuauuuaacuaaaaauauuuuuaacugcccuugagacuuccuuugugagccauggguuauuuacauuuuuaauauuugaguacauugugacaauuuuccagauauccuuguuauugauuucuacuucaauuccguuuugaucagguuacauauuuuguaugauuucagcucaacuaaauauguuacauuuuguuauacggcccagaauauggucuauguuauaugugcacuugaaaugaauguuuucugcuaucacugggagaccuguucuauaaauaugaguuaggucauguugguuaauauuuuucaccucuucuauguccuugcugguuuugugucuuucauuauucuauguccauuucaccuuuuaguacuaccacauugugcuuuauuggguaggagaaauuuuguuacauauauagaugcauggugaucaaaucaggauacugaggguguccaucacccaaauacacuacauuuuuguugaguauagucacccuacuuugcuaucaaacauuaaauuuauuccaucuuacuguauguuuguacccuuuaaacagggucucuucaucuuacucugucugcagaacucacccaguaucuguuaucuaucuuucuacucuuuaccucugugugaucaaauuuuuuagcucccacauauaagugagaacauaggauauuugucuuugugugcuggcuuauuuuauguaagauaauauaccugcuauagaguuucugauucaacauacuguagggcaaaauaaaaaaagggggggagggaaaaaauuaaggaacucacugccaccaggugagucuuuauucacgucuugauuucccuuccuaauuugcguauuauuuacuuuucacaguccuuaaguaauuuuguuuuguuuuuuauuuugucuaguguucuuaguucuaucaaugugagaaaucaacuacaguagacuuacuccauuuucucccaaaccagaacucuacauuucaaaauauacuacauucauauacauauauaacuugauauuuuuaccagaaaggccaaagaauuauuucuacuuugaagaucaguuaucucaccagcauagguuuugcuuuuaucauucuguguuaauuuucccaaggaaaugcuauguccuuucaaucuguauauucaagucucacauuuuuucuggaaaguuuucuuaaauuaugucuuuggauauuuuucccauuucauuugcucaguucuuuucuuuagggacaccaauuaugcuuauguuggaucgcuuucagugcuuuccauaucuuauaucuuuuaucuuuaguuuguuucuaucuuauuuucucaauuaaaaaaaaccuucuaugucugugcuucuuuuuguugcucccaacaugaccuucagaaaacaaaauaacuuuaauaaauacugagguaauguggcaaaauuuccauuucuuuggguuuagaguugaggauaagauauauuuugacaauucuugguguggucucaggaaguugcauaguauuuccccauaaccaccuagaaaucuguuucuaaaagacacaccuaacaaaacaauaaaauuuacuuuagaaaugugacuuuauuucuuuauaucuacauguguagucauauuugaaacauacuuuuaguuuaauaacuaauuuuaaacaggaggacuuauauuuguuauuauucuucaucaaaauuauuccuuuaacauuugaaaagauuuaagucuuguaauuauugcaaaggaacaucugcaguuuuuuuuuucuagcucucauuguaacauuuauuauacaaagugcauuucaagcaaaggagaaugguauuugacuaaaugccauuauuuuccucaguauaucuuauuauaauggguauuuuauuaucgaucuauuguaguucaaaacauuaguaaauaauauaguaaaaauugaucauaugacuuuauuccuguuauuucuuuuuaaaaguaguacaugcugauuuuuuuauaucacgcuauguucucauuuaaucaaucuccuuuuaaacagugacaagagaaugcaauaucaaucucuauucacuuuauuguucuauaagauccuguauuguuaaaggugagaaaauggaaucauuuuaaaagaucuauauuuacaauuuuagccuauaaauacuaucaaaggaauuuauugccaccauaagagcaguauguaacuaauggaagacaccuaagaacuuucuuacauaacauuuuuauaauuacacauaaauuaguaaccauuucugcaagauuaauuuuuauguucuguauauaugauaauaaauugauucaauuaugaaacauaaaaaugccuuuaaaugcagugcaguaauauaugcuuaauacaacaaauuuuguuacugugucagaagaggugacucuauuaucuauuacaaugacugccuauaaacuauugaugacuugaaaaaaaucagagaugacauacauauuaaauauugauuauaaaaguaagauuuagaaaacaugaguucuuuuuuuuugagacggagucuagcucugucaccaggcuggagugcaguggugcagucuuggcucacugcaaccccugccucccagguucaagcaauucuccugccucagccuccugaguagcugggacuacaggcccgcaccaccacgcccagcuaauuuuuguauucuuaguagagacgggguuucaccuuguuggccaggauggucuugaucucuugaccucaugaucugcccaccucagccucccaaaguguugggauuacaggcaugagccaccgcacccagccaaaaacaugaguucuuuacuccaaaaacccucuugaaaguauuaguuuauacccaaaauaauauagguuuucaggcaaauauuugaaaagaagguugaaaacagggaaccaacacaguacauuugaauuugauuuuauuguugucaagugugccacuuuaccgggacuugguauaaaugagagauaacuguauagcacauguaauuuucuuggacugaacaaaaaaaucagcaaagucacgauuucucauuguggauaacaaauauaccuguagagacggugaugaagagauagaaaugaguuuuuauuuccccuuccucauacugaauugccuauagaauaagaauaaaaucuaaaggacaguuuuuuuuuuuucuucauaaaguaguauucauguucuaugcuuuccuggaaauguaaauaaagguggaagcauguagaacaagcuucaguauggcuggauuaauaauuuaaaaaggaacugaagaguacauagaaacaugcacccugccauucagccaccucucaccccuuauuaacauuugcugagcaucaacuuauaacauaaaaaaucagagcucuuagaucauuuaaagcaaucuugcuguaaauccccauguaguauuccuuaagugugagaacuauagguacccucaaacaccagcguucagcuucuauauagaccacuuagcauaauucuuuuuucucuauaguuuuaaaugugugggaacaugugaucaggguccuuuuuauauucaaaaugggucagcuucugucuagaaagugucuuauugucaugaugucaccacaucucaagauuugugaccuuuugcaccauauggauucaugguaguccacauccuaguuuacaggccagagugcuuuugugcccccgcuaggggguaucaaagccuuuuggacuggaauuucaaguaccgauagauuuggaaaaacaaaaaguaauuuuuauauccuaaggaccgccagaugucgcaaaggcaucauugaugaagcggguuuuauccaaaauguggcacuuacauaaggaauaccaguauugugucugagaguuacagaggccauaacaggucagugaaauguccuucaaacaucugauuuuuacauucaagaaugggccaagaugaaaagauaaccacauaucugacauugauguuacuaccauuuagacaaccgauucaauugccuuagucagugagaucaaucaggccuuuauuacuuugaaaaaccacagaaacgauauaguuuuucuuuuucuuuaaaaaugaugguuuggaacuacaucuuaccacuauacuuuagcuaucacauuaaaugcuucguagaagcacuuauaaacuuucguaacucccccuaccuccuaaguuuaaagcauuuuaugagauguacaaaauuauaauaaugaaagaaaugcugcugagugaauuucugccgagccaaacuguaugcauaaauuggcaguuuaacaaguaaaacuuggaagcaagcauuugaugauugauuuuuuauugagacagaacaagcaugauaguggguaaagugauuuuccuuauugagagaaaauauaguguuuuucaacaugucucuaguaugaauggaagccuugucaaaaaaauggagcaacacauaauaucuuuaaaaaggugaauuaauauaucacuuauuuuauggaucaaauuuuauacuugucauuuuuauucauaaugucauaaaguuuauaccauaaagguaguauuauuaccuuuguuauguucugaaaaaaaacucugauauuaacugcuuuguaaguauauuauaaaauaccuucaguugaagaaaugcaguaaugaaaauuagggccaaaauauguauucacauguagaucuucagcaacucccuccguaauuuuaaguacuugaaauacauuauucaacaaguaaccugcuguauaucuguauguaauucucugcuugagaaugcaagaacugucaagauaaaaauaagaagcaugcaucauucuaauuuaauuacaauucaucaaaaauuccucuauuguauguauuacagggaacuguauaaacuuucuuauaaaaguaaucauauacuaaaguuaauugagauuugcuguuagaauuuuuauauauuuucuauugcuuaaggaauguauguguugauacauacaucaacauguaugugcacaugcugaauauuugauuuauguguauuauuucugcaucuauuuuauagucacauccaugggaaaauuuaaaugaugaauaugaauuucuuuauagagaguucuuuucaaguuugcaaauguacauuuauuuucaauuguguuuucuagccauaauuuuaaauucuacuuagcuguggcuauauuauucccacuuggaauuaaauguauaauaacauaaggagggcauacuccugcuguuuuucuggauuuaauuaguaggcaauguaugaauccaugguccuauuacauuugaguauaccauagguccauguucuaugugaaagauuaucuguauuuuauucuaagacuuuauguauauuuaaccuuuaauuugacuagcagguuguaugauuuacauaaaaaauagaucagcuuugaauucacugaauguuuucauauaacauaaucaaucaucucuaaauguuaaugguguuaaagagcaaugagagcauaugucuuauauuuguaauccuguggauuuaugaaauuauuugggaugucuaagagcauuagaucauggcauuucucuguaguuaggguucagaauuuuuuuuaguggcagguaucauuuuaaugaauuuggagaaucggccaaauauaagugcuuucuuuuuaaaccagaaauuaccuaauagguacccuuuuuaaaugaugaauuaccuaauagaugccuuuuacuagaagauucuuaugaauaaagguauauagguagacuauaauauggugcuuaaaaugcugugaccuugucucauuuucuuuucauuaucuuuuaaaaaauuugacuuucauugguguuauccugauuacaucauguacauaauuucucaaugaaauaaaaagucaauauaugaaugacuguaguaaggggaaaacaggauuuaaaaugguaaaaaaaucugcugugguaacaaagacugaaucaauuccucuguuguguagcagcuugaucauaucuuuaaaacugguaguaacaaagaauauuuauuuguugccaugcuauuguaggauuuauuuuuaaacucaaaucccaauuaucaagaaaauugcauccucuuuaucucacagaagggcauacggaaucauagcauauuugguuauuggaacuauaauauuguuaccuugcuuaaaacacauggucucucuugauauacaagaaaaaacugaauccauuucaauaaauuaauagggaugagaaucccaauccauccuucuuuucagagguucgcauacauuguaaugaaaugcauuaggaguuuucuucacuugaaauccaaaugagacccauuuuggcucacacccuugacagucucuuuuauaagcauugcugucuccuguucuugugugggccuaguaaaaugcuuccuuuguaagaugcacagagacaauauaaugccacgaaagacgaaggugucaaaacacaaaguuggaggcaaucuaaucaaugccuccugauuuagccuuugaaggcucucuucauuaaaacucuuuaauggugaggcuuaucuugagguagagcuguuacuuaauauuuuucagugucauucuuuggacagucauuuguaccuuuuaaauguauuuucaguauucauuguuuaguaaauuggaugucuuguuagcaugguggugguaugaaugacuugcaucaaaaugauugaagguaauaggguauaaauucuugguacauuuuuuucccuauccccuaaucuccaucuuucccuccaacaaaauaucuuauuuucuuucuaaauaucagguguaggaugccauuagacacuuucuaaaaacagauauuuagauguuuuuucauauacaagaaucggauuggaaaucuaaaauuaacucaaagcaauuaaaguuucuguuuaaacggagugucuugccauugccauucuuuuacugaauacacuuuucaaauuaauuuuuuuuuuuuuuuggucuggagcuuuugggaaaagcauguaaaucucacuaaagugaugaaaaaaaaaucccaaauguccguugcucucuugaauuuuuguuucucaguaaguagauaaggaaugcugagagauuggagagacauaacacguaaccaguuccagauaggguugugaacuuaggaauugucucuguaucagacauccuuucaaaauguuuuauuuucauagaugugaaaauauacaaaauguuuuugaaucuucacuagccucaucccucagcaauuuguucaaauuuaauaaaugaaaaacuuauaauuuuuguauuuuucuuuuguacaugaaccagauggcaucaugauuugacaaaauaaaaauacauagaggauacauuaaagaguauuuuguuaaugaugugugugaguguaucucuauuuagacucauauauuauacgcacacaacguguguucgaaagccauauccaucgagcaguaaauaggccuuaguuuuguuuauucacagaguauguaaucccuaccauaaacagauguaacaaauacauaugccuuugcauuggcacauucacguaagccauuuaaaaaacccaagaaaucaggagcuuaauuucuuuuaacaucaccaacuuaaaaaaaaaaaaguucacagaaugcccuugcuguccuuuccaccucaaucuaugauuaucaauaaaaaugaauaauuuauaaaauauggaaaauagaaaaggauaagcaucacagaauuuaugugcaagguaucuugaaaauggaaaagaauucuagcaacuuugaccugauuuuuaaauuauuacaguggugacuacagcugcucuagcuuaguaauuauuugugauagguuguuuuugagucccauauguauaggagcuccaggcccagcuaccucauuugcuggcacacaaacagauucuuccaggugcugaaaauuaaauuuuaauauauuauuuaaauauuaagagaauuacaguuucaguaauuuuacugcuacagcuggagugcaaggcaugccuguagaaugcagaguguugaacaaucuaacauauaggauguuuauagugauuuuaaaaaguauuagcuuauauguuuaacggauguuggcccuauuuggcaguuagauuacguaugaguaaccuugauuuagucuggggacccuuugcccuauugcaaacuauuauuuauuugucuuuuuagguuauuuaccuaaaaaacccugauuuuuagguuauuuaccuaaaaagacaaacauauccauggcacagaaauuuaagcugcuaaaaaguauauggauaagaaaucaaugccuaauguggcuuaguacaucuguauuauucugugcuaaaaagaguuuuaaaguccaaauaauuuuuuaauuucuuugguuucuacuuuacaaugagaaugaccucaaaaaguuguuggcuaucagauaaaaugcuaacaaacauuuaguuuuaaggacccuaaaaacacaugauucaucauuaacuugccucuugaaauuuuuguguggccuuuaauguauuaaaguuguguaaaaaccaauuuaagauaauguuuauaaaguaugaugccuuuuguuuggaauucagaguagggaauacauuuaaaauaaaauuuuaugucacaauaauuuguaauuuaauuuucuaugauaaagucuugcucuucuaggaauucuauaccuucaguaucacuaauuaaaauguauuuucuguuaaauaugauuuuaaccaauguaccuuuaaagaauggaagaaaacuagaagaugugcaauguguuaauaaacuguuuaccaugaccaacauuuucagaacaaaagggugauuugcugcccucaauguacaguaugaggaaaaacuucccaucaaugauaaucuguugcauaugaaaacuguguuuuacuaacuaauguacauuuugcuagcagaaucauggaacaagcugcaaaugauauaauuucacagugguuaaguuuacaugcuuuacuuagacucauaucucagcucuaccaucuucuagcugugugauuuugaacagccuaccuuucagugccucacuuuucuuauauguaaaauggaguuacuuuguaagguuguuucaaggauuagaugguuuaucaaauaaaaaacuucaaauaauagcuggcccaaaguaaucacuuuauagauaucaguuauuuuaguagugguauuuauauauuuaaagauaauuuuauuguuagcuacucacuuugaguacaugacaaguaaauaaaaucaaauacucaauuuuguagcucucaaagggcuuuaguauuugugcaaaagguagccaaugaccuugggguauuuaacccauuaaaauaaaugaacuccuuacccuuggcauuuuuacuuuagaucauaguaguaggccauuuauaguuucauucauaacuccagauacagcgugaaaaacugugacacaaacugucaaauaguaaaauauuuaacaaaaucucacuaggaaaaguuacauaacuacuucuuaaaucucagaacacauuuuaaaaauauaagaguaaagaauuugucagccuuuucauuuucccuucuccuguagcauaauucuagaaaguacuuacuuuuaaaagucuuaacugcuuuugaagaaucaggcugguugagaaaauuauuccaaaaaaauugugcaaaguauauucugaaagaaggauuaaaguccauguaacauaacauuuuucuuuuguaaaacaugauuuaugugugucaauaugaguaaccaauauuuuucuauuguaaaucaugaaagauuuggagugucugaaugagcaauuaacauacauacacugaguaccuaguuuggaucacaaccauuuuaggcuguagagggguagauagacagcaaguuggauaaaauccuuacuuucaugaaguuuacauucuauggagagcagacaauaaaccagugaauaaauauguaacauaauguugaugucaaggaggcguagaguagaauaacauaccagaagcugggaagggugugggaagugcagggguguggggugguggugagggggguggaugaagacagguuggucaauggguacaaacauacacuuaguauuuaaguucuaguguucgaagguagaguagggugacaauaguuaauaacaauguaucauauguuucaaaauagcuagaagagaggacuugaaauguuccuaacacauagcaaugauaaauacaagagguaauggauacccuaaacauccuaacuugaucauuacauauucuaugcauguaacaaaauaucacauguaccccauaaauauguacaaauauuauguaucaauaaaaaguaacauaaugucagguaguaauaaaagcuaugaaguaaagcccauacagauauaggguaggugcuuuugaaagugggaaaaccagggaagacaucuguaagaaaauauuugugugauccaagggaucaagccauggaaauuucuggggacaagcacaucaugcauagggaacagcauaugcuauucuguucagagacagaaacaagcuucacauaguccaggaagaacaagaagacccuuaggacuggagcuaaaugaguagggggagagacaaaggagaggaggucagagagguaaccagagacuagauugaaugguaggcugauuuuguaugauagcaagucuuuggaagguguuggaguugaaggaaugcaaucugacuuauacuuuaaaaauacugucugacugcuauaagaagcauagacucuaaagguagaaagaguggaaauagaaaaguuggaauuagguugauggggauaguaaaaaguaauuggacuuuggcaucuauuuugaagauccugaguuaaacaauaugaaaaauagaacucaaaagauugcugauagauugugagauaugaaagaaacaaaucaaggaugucucccaggccugagcaacuauaugaaugagcauaugauuauugagaugaggaaaccugggagagaaucaaguuuuggggaaaaaucaagaauucucuuuuggagauacuacguuugauagggcuuuaagacaucuaggaagaguaggagauggacauaguaauaugggacucaggagagauugagguuggaauuagugggcuguaaucagcauacagaugguauuuauaagccaugauggacuugacuaaaaucaucuuggauugagaucugggggccuagggcacuccaacauuuagaaguuggaaggaggaggauccaguuaggagacugagaauggucacuggaguaggagaaaaacuagcagaauaugguguucugagagccaagugaggcucucagggagagagggagugaucaagggacacuauuugucuccuuugagucacuugucacuucaaacacaaauguuuacagccagccccuggcuucagacaucccuauccuugucagucaccacacuuggacuuauuuccuuucccuuuaucucucaucaauaucaagccuggugcuaucaucuacagaaauauaucuuccuuacccacugguuucucauggugcuucucacuuugcccugguguuaguuuagggcugacccaggacaagcuuuguggggacaaggagggguaguauuaugaagaaaaaaauccgucuucaggcucuccucuuuuccuaucuguugcugcugccacaaugccaacguuccugguccuguccuacuuccucaacuucuuccaacuuccugcagaucccagccugcuuaguucuucuauguaacguuauguuggcuaauaauuauugaccuuuuacuauguagcagaaaauagcaaauuuaguauuagccuuuacucuuccugaucuguugagucuguuucuuuccuguaaaaggaaauaaauuugcaucuguucucugugcucucagagcucagaccauuguaccaccuccccuuuccuagucuccaauaauugguggaaccagucuggcuuuagcaaggacagaugugcauuuucuacaggaaauuauuuuccauauauggcuacuaauuucuacaguaaauuacgagucagauggcuuuuuucuaaaguagccuuauccuacuucaucguauuaauauuauuuguaugagaaaauguauuucaauuucuuauaaucaguuuacuaauaaaauuucagaaaauaauccacuacaauugaagaaugguuuuguguauuuauagccaucuugccuaauuuuauaucuaucauauaaugugcauacauauaccuauaaaugcuuauauauaaucuauaauagacuaacuacuaaugagucuauauuuaaauuuucggaaaugugcaaacuagacauuuuacacugaaauaaacuauucuauauugcuuuuaaauuguuuuauuaauuuuaacuuuuugaauuauagaacuuuaauuuuugccuuugacuaauucucucucuaaucuuuuuacuuucuaaauuaaugaauuuaaaagcauauuccacugcagaaaaaaaugguauauaagaauugggcauuuguuuuuuuaaguuaaauauuuuauaaaaagcaaaccauuuuuauaaaaaaguaauguuuuuaaaaauuaauguuucauauuuuaacaugaggcauuguaagauuaaauuaguuauccacacuugauucauauaaauuugaagauuuuuauggaaaauguaauuuauaaaaucaauagguuugauuuucauuuaaaaaauauagacaauauaagguuuaaaugcaaucuacauauauuuuaaagcacauucguauuuaucucauuuucacugcacaauaacuguaggacgagggcugauauuaugaucccuguuucauagauuaagacguuaugacucagggaggucacuuaaggucugggugcuagugagaaauguuugacccugucauucugauuccaaaucuaagucucuugccacugcccugugcugccuuauauuuucugagguaaauugucuuuaaguuauagcccuggaguugugcaaugcagcauaggcuucaguaacaauguguguuuagcuuucauuuuggcuugcuggacacuuauggagcugauuuaagccuucagcgccaaagucaaugagacucucuguguuuggaguagaucugugcagugcugagcaagaaaagaaacuggcaucuucaugcuuuguauuuucaaaauauuuuaaacacugaaaggcagggcuuucuuuucccaacucagcaugguaauaugguacucuggugagucguauguaacaucacuuauggauaguuauuuccaucagggaaauggcucagaccuuggaagaccaggaauauauugaggguugugacuucuaggcacuuagaugauuuuuacaguggugggaaggaaaccaccuggauucacacucccuucccacuugaggguugugacuauugauaagugagaagugaaacgugaguguucuuucucauaucuuacuaucuaguuuaggcauaggaaaaagaaacaaagacacuccugcuuuccuuucccucuuucucauaucacuugucaucaggagucauaaaguggaagguaaaugaaauccuguacuuucaaaaaugguuuugauuagaggucugaaaggauguauaaccaauugcuggugguucuuuuaauacagggugguuagcuuuggagauaaagggacacuuucaauauuuuuugguuuuugugcguaaguaugaauuaccuuuguaauuaaaaaaacaauaaaauaaacuuuuaaaaauugcauuuaaucacucugaaaggaugcaaaagcauacugccccaacucagaugaacaacuaaagccugacggaggaagauacauccuccugauucagaguggacuguuucuauuaauauaugacucucaggacagccagauggggugagguuccugccuggaccuccuagguauguccucaccuuccagagagcuuuaggaggccacagccaucaaugugaacucugaaguagauuuggauuuacugucuucacuguggauuuuugaugaaguagauuggaaauauaguuaaagggagacauguucacuuaccaguagaagcuaagauguucuuugcuaguccccugcaguguuucauauaagguuuuuuuuuuugguauuauagaaaauauuauacuucaguuuuugaggaaaaaaguaauauuucaggugguuuaguaguauaauauagaauaaaacuuuuaauacucauauuuuauuuaggccauaguaauaaaauuuuuauuuaaaguaauaguaaaaguauagaaauucauaacuacuaaugucuuagguuuaacuuuuuuucuaucuuuuugcuuuaaacacaaacuuuuuaaaaauauauaaauguaaaagccauauauaacacgagauggcguguacuacagacacucauuaccauuuggauuuaauuuaaccucguuguucauuauuuuguaugcugacauucuaaaauuugaguaagauccauuuccuucaaacaaacccaaaauacacauggauuugcuugauuuuauuauugugacuggcuuaacucaaaauuaaaggaaguagcacccuugccaguuaauaucaaaaaguuaaguucugcauucugacacauaacaccgugaacaacagauacaaagagcugaacaaugcuaaaaacaaaguuuaaggaauagaaaaauuugguuuguuucuaguagcccucuuuguaaugcgauuacacauuauggcagauccuugaagcuaucaaacuguacaguaauuuucauuguucucuaagccccacaugguaugacugggggaaauaauaauuaauauaacuggaauuguauagucaugaauaaauuaaguuuuaaaaauaacuacaauuuaugucacauaaugaaguacuuauuuuuauuuuuuccuuguauuucgacuaacauacuaagaauuugaaagcuauuguaagaugauaguggacuauaaaacuuaggcucaccauccaucccuuuuucucaugcucaguaauuaaaaauggcuaugggcauuuuuuauccacugagauuuaccaacugcuauagcauucaacauuuauagaaggauuucuacacccgcuuuuuaaaaaaugaaauaaccaaauauuacagcagcuugaagugguuucuuaaaaaaaauaauaaguuuaccucuaggccucugauuuucagcagauagaaagcgcuaucauuagccuaccauccauuuuaauuugaaauccuaagaacaaaagucauuaauaaguccuuugucauggauuuuaaaaaagaagacgccuuuuuaguauuuguaugucaucaugccaggccuagaaaauuaggcuaauuuauuauuuaaaacacuggugggauuccuaauugcauucaucauuagauaugacacguuuagaacugagaaccauauccagugagaauuuuccaguuugaauuuugaaauaaaaauauuuuucaagagaucccuagcuauugccuguuaccauggcaacaguccuauuugucugagagcucuguccgcugccaaugagagagagagcaacgucaacuaaacauacgaauacaucaaagacaaauucauaugcucaaucugaucagcucaauuaauguaagaacagaagcugaaggggguuaaaagagggcacccauucaggagagaugaagccccuuuuagcagaauauacacgccggccuuuugggggaggaauuuagcacacugucaaaaacauuaucagaaaaagaaaguaguaggccuccuacaccuaacagauaugaagcugucagacaaagaauagcacuauucauuaaaugacacuuauuuucucccacuuuacaagaauacagcgaacaaaacaagcaggggagcagcugagaaagacacuuuuuucuuuugcuagugaugacagacaugcagcaauuauggugauaacugaggaauacuaaacaagaagccagcuuccauucuguuuaucaccuuaaauuuuauguuacuaaauuugcaugcaacuccuguuuuguuuuauuauuuaugucugggaaaaauuagaugccuuuguuuuuaacauggugccuugaguuuggugcagcauaccucuaaacuccaugcauucucucacuuuucuuguuaaauggccacaucaaguugaaaugcuuuugaaguaagacauuuccaaagcacaacaaaacugcuguuauccaugugagguguauguggggcuugguagucuggguucauuaguguuaggagagagauauauugcuucugcacauuuuuugaaggaauagagcaaaaaguuauauuaauugccaccuuugcuuucaugcuucauuguacauggugaaauguguuacagcauauguguauguguguuuaauagauccuucuuuuuucuucagagaaguugaaggugguagguaguagaaacugucuugcaggguuuauaacaggugcaggcaaguagaaguuccccugagauagcugccuuuuaagaaucuuauguuuaaaccaugaugaucugauuuaaggcccauuaucaauagucugcuacuuauaucugcaugaucguggacugauugauacugacuuuguagccaugugcuccauaaugcgcugucaggaaaugcugacagaugcaaugaaagaacaauaaauguggggcagccguaagguaaagguccagcuaggcuguaugaaaacugauagcuaggauauuggcuccuauguuaccauauacaccaguaccuuugagaguuuagcuggugagugaauuaaaauggucuccugauacccaggaggggggaaaauaaucuucauuuaaggaacuugccgacuuugccaaaacauugcuuuauaagaacagagccaagauacaaaaaaaaaaaaagaaaccucccuuauucaaaaaucuaggcaugucugacacaucugagaaaguauuucguaaaaaucaauacacaaaaagaacacuguauccacucuugaugauacuuaauccauuuguauaaaauuacaaaaggagacauuuuauuagaauuccugcuuuaaauguauggcauuugacacuacuuaaaaaaaauucuugaucuucaacuuugugcaugaagauagcuggcauuuugccaguacagguuuuuaacaaauaacuaggauaagucaauuuauucauaucgagccguaaaaguuacucucuucucccuagucuuaagauguagcucugaaagcaguuggauuggacucuaacucaauacauuaucacaccuuuucuugcucacauauugcuuuacagauacccucuguguucuuaaguaccacuuaauaauuaccaguauuuaaagauauaaugaacauuccaagauugaugucucaaaguagacuccuaauacauuuuaacaagccauuuguuccaaaauuuauauuuauuauauaacuucgaaaauaaacauagaaucugauaccagaccuuaauuuuuccuccuuugauuagaaaauguagaauguaauguauacuuauguauuuucaauguugagccccugugguaucuacaagcuguguugauaauuuugauucguguccuucaggaaagaaaguaaagaauauuuucuuuauuuacagaguuaucaaaaauguuuugggggacccuuugaaucuaauuugauuuaggaggaguuugugagaauaauuugacccggugaauuuaauguuugcucuaaaccuuuuuaugguauuaauuugccacauuuaaaauaacauugaaaaacaaauuuuuagaaugaaaagauauaguuaaauuugaaagaugcuaucuucugagggugcucaaagaauguucuaagcagaucauugacaaaacaugccgaugacuguaauugugugaauucaagagaaugaguuuuuuuacaccauauuauugacauaauagauugagucaucauugcugucugauaugcaaaagcgugcuuaagaagucuucuguggaucaucuuuagaacgcaaaauauugacacaauagacaacaauggcuccuuuggagccauuaggguccaucauuucagggccugcucaggcauuucuuagcagguagcgcacagacucuugacaugagagaucauaacaaguccaaaggaauaauacucguuucuaagauuaucucauacuugggaauuucauaagcuauaauuuauuaaaauuagaacauauuaucaccaaugugaauuuuaaauuaauucauuaauuauaugcuauuaguaacaaacauuuuaugcacacacacacacacacaccauguauauuauaaacuggauaaacaaacuauaucacaugcaguuauuuauacuuuucccuguguaagaacuugagaaguccacacugauuguuaugaauauucauaaaaagcaauucauucucagccuuauaccuuuuaugccaagagucagccuggagcgaauuuuuaacguccacagcauagaccuuugaaaguagaugugccuaauggagagagugacacugacucugacaggcaggagcucuggagcucuggugggcacccauauaauuagaucuuuuguguggucuugcuagcuaaggcagaacuugagguuuuacuaacaaaaucuuuugaaaagaaacuucauuucccccaaaguuuagguuauuuaccacguaaagaaauaaaaacaaaaucugcaaauaaaaacucccugguaguuuuagaugauuuguauuaucugcagagugaaagaugaagugagugauguuggauuggcucguaaggagagcaucaugcuuuuucuuuucgugugaauaguuuuauuguguugagauuagagacaaauagaaauuauauuauacaauguggcaagccauuagcuuuucauaaaaagaaauuuuaucuacagugaaaagcuuuugaucuuagagacuuucuaaaaagcuuuuuaaguuugauuuuuuggugguguuaguuuguuauuugguguaagugucaguauuuuuguaaagaaauuaugucagguaguuuugcuauuugcguggcaguaugagacauuuaaagaauguccuuuuugaauuuucauuuuaaaaauauaaauucagcuuauucuucaaagcuuuaaugaauguagguuugaacaagaccauauauaagaaauauaguuuucuaacuuuuauuagucacagauucgucccccugcucuuuuauguuuuaagguuccaagcaauaccauaagcuucaaaaagaacaacaacaacaaaaaaaaaacccaaaaaacaaaaauccaaaaacaaaacaaagcaauugcuuugaacugacaaacccauuuuaaucuagaaaauucccuuucuccuuaucuuuaauacucuuagagaauuggaauaggccaaugaaguuucuguuacugaaaaaaaaugcaauggcauaaaccuauugcacacuggaggucacccuugcuauuuacaauuuuucuacaauuuuacaaaacaaaaguagacccugcaugauuuuaaugcacacuacaguuuucaugauacuuuugguauaaauacauggauguuauaugucuucuguguauaguuagucguauuaagugcaauuaaggaacccauuaugaaaaucuuauggcugucugauuuuucugaugaaauaagcaaaugacaagaagcuuuucaaaacaaacuuaggagccuucacuuucauuauauauuauacauaaugguuuuugaaaauccuuucaaauuguuauaacagaauucuagaguagaguucauaugcacugcuuauucaauaauuugucagauauauuuuuacuacaucauuccugcagauagcuuuacccuaguugauacuuaugacuuguuguagauaaaauuacuucuguaguccuuuuauguucacauuauuuauugugguaugcuuaauaguugauuauguucuauuguuuucccaccacauuacuuuuaugucuuaauauucauucaaaacaaaauaugacaugauuuuacuaagaacaaaaacuauuuuaaaaaauauaaguaagucauauaugaacauaaaauuauuaaacuaauuaagaacucugguuuuguaaauaucucaaugacaaaacaugaaauagaagaaaaaagcauuuagucuauaucuugaagcuauucaaaauaggagccaaagauagaucgaggagaagugccugaucccguuucaguaagaacauucugagaaugugagggauuauccucugggagcuguaaugagcaaaaugugaaguuucagguguaccucaucaccaacuggcaaugagaauaacaagaaauagagauaaagcuaccuuuuaucuauuuuccaaaggauggaauaggaauaccaugaauuuuucuugaugcauguuaacuuaguauauguggccaauuuuuuucucacaauuuuuauagcacuuuuuagucuuuaauuaaaaagauccuuacaauuucauaaacacugaacauaauaugucaauuaucuggugcaaagguuagaugucagaagugaguuaaaauaugggaagaugcuuuuaacagauuuauaugagauaacaagaucaagggaacagagggaaaccaccagauuccccagcuaaauagaauccuaaaggcauccacggauaucuguccacaaacagagcaccucaaccccucucuguuauuuauacugugugagguuucaugcacucuccuugucccucucuguuuaggacucauuggagggaaccgaugaaccauacagcaagauccagauggcugauuuuuacaaagaggggcaacugcauagcaucuucuuuucucacuuuccuuucugagauguugccacugucguauccuaugccugaaaccccccuuuuuaauggagugauuguuauugaaggcucaaugcugagugccuccguagaggcuuucccaaacacucuugcacucaugaauuugucuuuccugaacagcauagcacugagugugcuacucauuuuggauuuaacaugugcauuuuugggguuuuaaccagaaacugugugcuuggcuuuuucaucagugaguuuguauacccaguugcagcaaguucugucucuuuucuccuguaauccucacuguccugagcagaacacuggacacugaacagcuggaaguaaucucucccuccucugaacucucacagcaccuccucuguaccacuucuuuguggcuuaucacuucauacuuuauauuacaguuauuugagaaaguguuuuaucuccucggcuaaaaugaaaauucuuugggggcaaaacuaugucuuaugcaucuuuauauccuacacuaucaucaccacaacaaacauacuuagcaccauguuuuccauuaaauguuucaccaacuuaacucacauuuauugaauaacuugcuacagagcacuaugcuaguucacuaguacaacacaaaguaucauuguuuauacaugaaggagccuacaggacagugauugagagagaauugaauaugacuaaagaaaagcaaauagagcacacugaauuguggcugagaauuaaaguagccaguuucaagcuuccaauuggaaauuugguaagugguugcuguauguuaccuuuaaauccaauuucaauggaaugaucuauggcaaagaguucucccucuggaaggaggaaaacggccugaauggaaaggacuuuuuauucaaucccaugccaccaaaaggggcaaugacugaaagaccucuuaagauugagcaccugauuagaucuaaggccaaauggaaggagacacugcacagugccaguacucauauauuucuuuaaugaaugaaugaaugaaugcagauacucacucuauuuauugacugaaugaaucaucaacaaucucauuuuaaaacaugaguaaucuuuguauucagcagggaacuuugagcuucauuuguugaaaaucuuauagagucccuugaauuuauguauacauuucucuguauaaauacauguaccauugugcuuugaauaugaucaugauaaauuccauuuccuucugggauuuuacuauuuuuccuuuacuuuaagcccaguaacugaguggcugcuugaucuuuaaaaccaauacuggauugagagcuccuugagagaugaaacugcaucuaaucauucucucuccuguaagugcuuaaauucuaauuuaaauuugauuuagauuagaaaauaauuuccaagugugauggauauaaugcaugguguuggguuuugagaggucauggagugacugcccccacaguaccagaggucagaguauuuugcccuuagcagagacacuugauaaauguuuguagaauuucauuucauuuucccaggacuaacaccugaauaugucuguguugcagugaugcugaaagauuuaguauugaaaaacucuuuaaaauccucaaucacucuauuccaaaugauuaaacucuugcuuaucugcagugaaaaagacucauguucuuugauccuguagaucuuuuggucuaccagugguaauuuuauucuuaguagcuuauuaaagaugugacauuauaauaccaaccaauaaauauuuccucagaguccugagaguguguuuccaaaaagcacuauaggaacuaaaaaugauaggaggaaugcuccuuccuucaauauuaccaucuuuggaagagaacaaauuuuaagauaacgaaaauauaauauaugguggaauaaguaccaaaugacagaggauucuguggggauccagaggaagacaaucucuguuuucgagguggaguaguuaucaucuuaucugggaagaaguagaauuugaccugcaauuugaaggaagaaacuucaucuagaugggugaagauuuacagggauaguuguuaguguagagcaaaagaugcgagcaaggagccaaagaugaaaaaaaagcauaucgcauuuuggagaccaugaacaaaucauuuguugaaauagaagaaaucaaggcuagaaagauagauuggaaccaggucacagugggccuuauauuccacagaaaggacuauucccuugaugucuugggcuuugagcacagugacagggugaacaacuuuucugaaauuugaauuauaaaaccauaacaauugaagaaacaucagagggugacaggggcauagguacuauuauaggcagccaaaacuaaagugaggggaaaaguagauaguugcagccugucaggcacaagggaagaagcaauguaguuagaaaaauacgguacuuuaaaugaaguuuucuuuuuauaauucucuuuccuuucaaaauccacaaccucccgcaccuaucuuuuauuuuaugaaaaaggaagaguugaucuaaagacuaucagugguaaauaagggaauguagagcaucuagaaguuuguaaaaaauccaccugagaagauauggguaacaagauaucauauuacauuauuuaucagaaucuugagggaaugaguagcaaguguugguguuugucagaauugccuguagagguggguauagauacaugaaccuaagcccuacgcaucauguaccuauuccagaaugccugguaaugacguucggguaucucuauuuguaaucagcucuauagaugauuugaaugauuugaaaaugaugacuaucauguguucuuucuauuuuucucucuucacuuguuauuaaggcaauuaaucacauggacaauuacggaaagaaaugagggcugcaacauccacacuugaggauugauaucaguauugcucgguauuguuaucaaucaguauuguuaaugauaucuuugauaauuucccucuaauaucucuauauuuuccucaaaauaaucccuuaaauauuauuggggugaaaauaguuuaucuaaguaacuuuaccaaguuuaacugagggcuuaguacagugauagaauucaauugucauccuaccuaucuggucaggauuccuagcauccuauaaaguaaaguauuucauauucaucaaaaguucuaaugugacauuucucccgugugaaaaaaguaugaauggaacuuacacaacuuuuuaauauggugcuggauuuuucucagggaguucauuauacuaaaucauuuugucaauuuuuaaaugaugagggcauaucuuuuccaauguaucaucuuccaauguaccaaguuuaggauuuuauacuuauaauguuguacuuacuggucuggacagcucuauaaaguaauguaaugcaaaauauuauugauuuugggaauuagugauauaauuaauuuucuagaaaauaaacucugaaauuagauuucacauucccccuuuuuuuucucuaaauaugagucgacauauguaaaaaccagucagguggccauagcuauuuuauauguaguuauuuuauauauaucgcuauuuuguuuuauucauuauuuuguuuucaccaaacuuuaggaauuuuuaaagcauuaagaucuugggccauuggagaggugggggaugguucauggagagauaauaauguacauauucuuucaauagguaggagguagcuaaacaaguuuuaaguguacuauaauuuucauugugacaaguucgcuaucacuuauuaacauuaaaaguaauugcgaguuagaugcuagcucuguuucuggcaccaucugagucuccugauaucuucagauccuucuauuuggaacuugcauaaucaccuuuuacauucacaaauaaguuacugagucucugaugauagucaugaaaacaaauuuuaauugaguuuggcaugucaaaacccuuucuuggguuuuauguuugauguaccaugccacauuuucagugaauaaaaacugccuccuugcauauuuauuauauauucucaguuagugagauuuuguuacacaagcagucaccuuauuauuuuuuauacgugcacuuugauaucacaguguuucauugucaauugacguaauguaucagaaguggcacagcuaaugagcacacaguugccuuuagcucauuuuacaucgugaaacccuacuggggaauaggcuguaaaacuugguggagggguucugacauuuuauaaaugucauaugucaauccuacauugugauggcugugaaacacugugugcugaugguaccauagucauaugauagaccauuuucacuagcaggcacuaaagaacagggugugugugugugcauaugugugugaaagagauuucuguuugcaaguaaacuuuaagcuuuuuggccuguguauaggaauuaagaaagauuggucauuauuuuauuaauauaaauuaguagagacaaaaucuuggugacaaaauacaaaauguguuaugaaaacuuaaauuccacuuuucuauucuuaaacacaaagaauauuuugaucuuagaacaauaauuaagguauuuucuguuuccauuaaucuaaauugcaauuuguauuggaggaguaaaaagucagggcaucuuauuuaaacuuagccuuuuuuaaagguauguuuuaaaaacuuguuuaugguauaagguguuaacagguaauuuggucaguuauuucuuagugcaugaggguuuggauuuuuugaauaaaggaaauugcauuaucaauugcagaauaacaaauguaguuucauuuguauugcuucuaggaguuuaugaaccauauuuugucuugugguaacuagaauuaugaacuuggaaugucauagcaaaugauggcugggguauuuucaguucugaaauguuuuuauuuguaaacugguuaauuuaguauucaaauauacuuauuuuuuaaaauaaaaaauuuauuuccucugaggccaauuguaugugucuguguuuacuguugucagagguccuuuaauggcucacuuuggccucuguugugaccaaccagaaagcaaagagaggacaaaaauggaaaaaaaaagauauaggcugugaaacuguggugaaaggggaaauaauaacaacacaguuaaaugagauucggcgagucuucugaucugugaacauuuuuauuagaaacauuugucaaccagaucggcaucuuccaguguuaccucuucucuaguugauacgggucacccccccucaccugccguauuauucccucucuugccaggcuaaaagcaguagcagcacugcccugcaauuauguaaugucuuaucauugucaggacaccuucacuuacaacaaucccugccauacacuuaugccacagggaggcaggcauuauuuuuucuauuucagagaaacgacuugucuucguuucaugugacuaguaagaagcagagccagcaaugucucaugacuuuuaucauuucuagcccaguauuccuuccaccacacaaaguauuugccccauaaauauauucagguuucuucccaugcuagagauuuuuaugcaaacuuaauaauuaauaacuuaaagcaaaagugggguuuauugaaaguuuucugggccaaacagaugugcaucuucugaguccugucuucugggcaugaucuaauauugaaugcaguauuuaaugauuaucauucaaaaaaugaggcgagaaaucaauugcuuuguaaaaucaugauaguauuaagcuacagccuuuuuaaugaaucucucuguggccaggccucaccauggugacuugaguguguggcacaccuugggaacuccuguucgauuuuaucagggacaggaugaauaguggugcaggggagccucaccauggagagauugccacagcuuuuccccuguucuccuaggauccacuuaaugcguuuacuaauuauguuagaauugugaaauuuaguggaaaggacugugggaaugaguuguuuuuguugugaugacuccuuuaacuugccaacuugaauuugaaccuucuacuuuacaggaccccaauucuucuuuauacagaaacaaauauauauuucuaaguuuuaaaacuucccacuccacaauuuaaaauagcuuuugugaaauuuuuacugagaaggccacuuagugggaaacuccagcaucauauuuacuaauaaacacugauauuagagcuagcaauuuguuuauuuuuuaaaaggguggugguuuguuucuuuuucauugccauugaaauuaucccuaauauauggaccaguugucuugacugaauauaguaauauauguuuuaauacuuuuucaaauuuuuaaguaaaauuugguuuuaggauuccuacuuuuauauuuuaaauuugggauuaaauauuaguuuugagauauuguugaaaaaguuuuaagacauauuauaacuugaaaagauuuagaaaauuuccauguuaagcugaaaauuauauuucuauuaaaacuagguagcauuguaaaaauugugugugguaaaaaaguuaggccucaguuguuuuucuucuuuuuuguuaucuaguugucuccauagcaaauauguguauaugcaauuguguguugguuggacuuaugaguaauguaaacaaugugucuaguguugaagugcuucuuaugaacaucuucuuuuuaaaaguaagaauaauauuaguuuuacuuuuaaguguauguguuaccugacauagcuuguuacugcucuaucaucugaaaauaauuguaacuuauaacuuucauuuccuuuaaaugaagaaggcaacaauuugaaaguaucauuuucucaugaaagcuaaaaauaagaacuuuguuuuuuggcaguauuguuauaaauaaucugccuaaacuauuaacuguaaauacauuguuagagaugugccaagaggagacaacccauuacauuuucuuuguuuaaaacuaucuaguucuguuguugaguaagacaauuuauucauacaaucauauaaaaaucauauuuaauaaagaacaauccaaggcaaagagaaaaaaaugucuuuauccauaagcaaccagaugagaaauggauuuuuauucagucagauccuuuuagucaaugaaacagcauuuucaugcauauugcacacaagugauaauuaauauacucuaauucgggacaugaugcuugaauugauguacugucaucaauaccccguguuaaaaucaaaccuugacagggguuuaacacccuggaacaggucaucauauauaauacucuuugccucucaguauuugucuucaaccaagcaaaguauuacaagaugggguaagaaaaaaaagggaaauaauuacaaaugaagagugacgcgggcugugaauagaacauauguuaggcuaggcagaggcaucagugaauuauaucauuucaugaugaagcgcaacuggggcugaacgggccuauuuuaaaacuugauguauuuuaucucuacuguauuuggacugucaucuuuggagaaagacuugguauaauugagagucaacuccaaucugcaugacucaagcaugaagugggggccagaugagcucugcuauggaggccagggaagcuucuaauaagauaaaaugaacaaucaccuuuuaugccuuucaguuacaaaugcauucggugaauacaguuuucagaguuauggcuuccaaaugucacugauauugcaaaguuuaggaaguauucugauaauuaagauauaaaaggagaccagcucauuugaacacucauuuuagagggauaaaaucaaaaccuguuuuauguuaguuagucuuucuuugugaaaaccuauuagauguaaucagcauaacuuggucauaauguguuuucauuauguuugauuuuauuuggcuauuuuaugaaaauccuugucauuuuugcauauauuaggcuaaauguccuuuaacacccacacacaugccucuucuuuccugaaauuuauggugauauuuucugccagaagaaaucacucacuucucugaauacguuaaguacuuagucucacaacugugcuccauauuucacaauguuuucuguuuuaagcacucauauacaggguuuaucucaucaacuaggcuaaaaucuccucaagggcacaagccauaguucucauugcauaucuaccauacugcuaggaacaccaccuuguauagcagguaaucagcaauguuuguuaggugaguaaguaguuuugguuuacaaguauauauuuuuuauauauauauauauuuauuuauuagguuuaagaauaguucauaauuuucacacucauuacuuuccaacuaaucaaucaacauuguuugguuugaaaaaauuaugaaaugucugugugacacuaaguugggggauguaauggggauaaaauuaaguaugaacaguuaccacuuauguccacauagaauuuacacacguuuucuuucuacccauaaauuaucuuccuaacuuccuggaaauucaguaggaaguagcauuaacucaaucucaaauuucuaaaagagcaauuuaaaagugaaagaggcuaugcagaauuguuagugauaaagauggucaggaaacccugugauucaguauuagggccagccaaucaguguuuccuaugaauuuccuaucauccaccuauuaauccucuguaucgaguaaaaccuauccauauagaagaccagcaaacuucagcucacuccgugucagcaaguguacugacucaauccgucaaaguagacagcauugaugucucccuuuuuauuuucucugccaucucuuuuccucccuaacccccuaaaaugggcuaccugucaauuguuuacuugcaucuauaacagaaaaguugcuucuuuauuuaaagucuaauuaaagacuacacuuggaagcacauuuagcaaauucaaaguuuuuuuugaaauacauaaguaauaauuuuguuuagccauagccuuugagcuucauucuuuauauuggcaaacauaagcagaacuugcuauucuuuucagauuuuggaaguuuuuuuauaaacauuaauaugacugaaacauuauuacuguuuccuguuauacaauccuacaugucuaccaagaguacauguuuguguucauuaccuuuaaaaauaacugagauauaucaauuaccaucucauuuuuacaaguuugcaaagacucaucauuucuuaaauuuucuuaaaauuuugauauuaaguaaauuuaauucaaauaaauuaacagauagcaguaaugggacaauugaauaagacugaauuacaauuuuaaaauguauaugcuuuuggagcuauuuaucauuuuuuaggaaauacuuuguaaaauaaaaaugaauaacuagaucuguuaucauucuagcauaauuuaaaccaagguuagguauaugcaccuuuacagaagaagacagggauuauacaaccuuagugcaugucaucuuuuaucuuaacaauuaauuauuuuuaaauauauauguuaaguauucuuaugaucuccuaauauguauaaauuggauacaauauuguauuaggugagauauuauguguacuauaucaugacaccaauuuugucauuuaaauuuuuaauaauaugguuauucauuuguaaaauauuauaagacgucaugagggaaauuuauauauauauaacgaauuugcccacaauugucuguuuuuaaauaauuuuguauuggucaauugucuauaaaaaaaucuaagaaagauguuuuuauuucuuugcccucauuuuccagaggaggaauagauacaaauauuuaguaauuuuuaccuagacaaacugaaauaguuauuggcucuagcuaaggaacucaugaaugccgacacccuguuccuugcucuaacauauuucaaaaauuaauuaucucuuuuuacuuaagcucccaaaagccauuuaaacuucuauaauuauuauuagcaccauagcucugccuucaguauuaaacuuuuagguguuaaaauucacauuaggaauuucaaauuaugagggacaguagaauucaccuuaacaguuuucagucaugaauuugaguaaugcuauauguuaaccugaaacaagaaggauuuacauguguguuaaaauguaagauugaauucaggcaaggaaugguggcucaugccuguaaucucagcacuuugggagacaggagggucacuugagcccaggaguucgaaaccagccugggcaacgcagugagacccccaucucuaaaaaaaaaaaaaaguaaauuacccaagcgugauggugcucaccuguauucccagcuacucaggaggcugagauggaaggauugcuugagcccaggaguuugaggcugcugugugcccugaucaugcuagugaacuccagccugggugacagagcaagauucugucgcuaaaaaaauaaauaaauaaauaaagaucgaaucuauaguuauccagucagugcccaaucccuaauccuuaagaaauuucauaguuuagcuuguauggaacucaacuuuauuaaaacggaaaaaacauggaagugcacuuaaaacugaauggaaacaaaaaaaauaaagccuuuugcuuuguuggugaugugcaauaugcugaagagaaaguugugaguuccugcaacugaguuaccugcuuauuuauuacucacccacacagugcgaauugaggguuaccuuacccuguuaccuauccuaagagcugauaaaaaaggaaagcuugggucagacuaaauauuucucuguggugacacauuuuuacaucuugacaacgaacuaccuugccaacugauucuccagcugcucaagcacaagaugaacguauucaaaggaaucccacugcugcuacuuuuuggaaggaggcagaucaucauuucaacacuaaacuacucgaaggaaucugauuuuuggcaauucuauagauucagaccccuccuaacuuucuucuaaugugcccaggacagaaaucuacaugaaugagaugugagaaaggaggggaaaaagaaaaagcaguaacaaaaugaaucaaacagaugaaauggaaccucaaaaauaagguguaaacauucccuauggcaguucaaauucauuuuuuuccaucccgaaaugaagagugcuuacgucccacacaaauaagcguugccuucaaauuucugggcauuuuuaacuuuggcuuucucugagcugauggcaaauugaagagaugagcauuuccacaagucuucuuaguuaugcauuuuuaucauagcuaaacuauggaagaaagaagaaacuacugacaucaguaaauugucuaaggcuccuauuuaagugagcaguaugcuaaauacaguugacaccuggaguagaucacucuuaacacccgccauucuuacuuuuuuuuuugggacggagucuugcacugucacccgggcuggagugcaguggcgcaaucucggcucacugcaaccuccaucucccggguucaagugauucuccuugccucagccucccaaacagcugggauuacaggugcccaccaccacaccuggcuaacuuuuuuguauuuuuaguagagacggguuuucacuauguuggccaggcuggucucaaacuccugaccucaugaucuguccacguuggccucccaaagugcugggauuacaggugugagccaccacgcucagcacacccgccacucuauacaacaaaaauauuuucagcaauaauaauaaacugaaaauaauaauagugaugacgcugggugugguggcucacgccuguaaucccagcacuuugggaggccgaggugggcggaucacuugaggucaggaguuugagaccagccuggccaacauagugaaaccuuaucucuacuaaaaauagaaaaauuagcuggguguggugacaggugccuguaaucccaauuacucacaaggcuaaggcaggagaacugcuugagcccaggagguggagguugaagugagccaggauugcgccacugcacucuagcccgggcgacagauugagacucuaucucaaaaauaauaacaauaauaacaauaauggugaugauagugaugucuuguggggacauauauacugaaaauuuuucuuuauugaacucugaguguauaaugucaauaaaaacaguaaaugauuaaauaucucagcauaggaaaaggaaaaaacauaauuaauacuuuguaaucauauugguguauuuuuuggaaaaggaaaaacacuuuacauuuugaaauuuuaaacacaaauaaaacuccaaguagucauauagaagaagacauugaaguagcucaaguucuguuucuucaucuuuaucucacugugcuaucauauguuauuuugaaucuacuauuuagaugcaggaauaugucauaguacaggauuuagagauaauaacuguauuugaagccagccugaacaauuuagagugguuauguuuuuacucuggaacuuggucuugauaugaucacaugcagccgaguuuccaugugccugggcugaugaaauaacauuaaguucucugaauuaacuuccauguugaauaaaauguuuauuaaaggauaaguaauaaaaauaugcucauuugaagcuugcguauauauuauuacaauucaacuaaaaccacaauagcaguuguuuagaauuuagaccaauaaaaaauuuuuaaggaggauuauuuuauuacugacauuauuuaguauuaccaguguauggugauaguaaaauacagaccaaguuuuuguggauguuauuaauauauuaaaauuuucugguggcuggcaagauggcugaauaggaacagcucuggucugcagcucccagcaagaucaaugcagaaggcaggugauuucugcacuuccaacccagcucaucucacugggacugguuagacagugguugcagcccugagagggcaagcagaaguggggagggauguccccucacccgggaagugcaaaggaucagggaacucccuccccuagccaagggaagccgugagggaauuugccaugaggaacggugcacuccggcccagauacuaugcuuuucccaucaucuuugcaaccccagaccaggagauucccucagcugccuacaccaccaaggcccugggauucaagcacaaaacugaguggccacuugggcagacaccgagcuagcugcaggaguauuuuuuucauaccccaguggcgccuggaacaccagcgagacaaaaugguucacucucuuggaaagggggcugaagcuagggagccaaguggucuauaguggaucccacccccacggagcccagcaagcuaagauccacuggcuugaaauucucacugccagcacagcaguaugaagucaaccuggaaugcucgagcuugguggugggaggggugucagccauuacugagguuugaguaggcaguuuuccccucacaguguaaacaaagccaccuggaaauucaaacuggguggaacccccgcagcucagcaaagccauuguagccagacugccucuuuagauuccuccucucugagcagggaaucucugaaagaaaggcagcagccccagucaguggcuuauagauaaaauucccaucucccugaagcagaggcuuugggcgcagcuucagcagacuucaauguacuugccugccagcccuaaagagagcaguguaucuccuaguacagggcucaagcucugcuaagggacagacugccuccucaagugggucccugaccuccaugccuccugacugggagacaucucccagcagggguaaacagaccccucauacaggagagcucuggcuggcauaaggugguugccccucugggacgaaguuuccagaggaaggaacaggcagcaaucuuugcuguucugcagccucugcuggugauaccuagucaaacagggucuggacuggaccuccagcaaacuccagcagaccugcagcagaagggccugacuguuagaaggaaaacuaacaaacagaaaggaauagcaucaacaucaacaaaaaggauguccacacagaaaccccaucugaagaucaccaacaucaaaaacaaaagguagauaaauccaugaagaugagaaaaaacuagcacaaaaagucugaaaauuccaaaaccagaaugcgucuucuccuucaaaggaucacaaguccucaccagcaagggaacaaaacuagauggagaaugaguuugacaaauugacagaagaaggcuucagaagguggauaauaacaaacuccucugagcuaaaggagcuuguucuaacccaaugcagggaagcuaauaaccuugaaaaaagguuggaggaauugcuaacuagaauaaccaguuuagagaagaacauaaaugaccugauggaguugaaaaacacagcacgagaauuuugugaagcauacacaaguaucaguagccgaauugaucaagcagaagaaaggauaucagagacugaagaucaacuuaaugaaauaaagcaugaagacaagauuagagaaaaaagaaugaaaaggcaugaacaaagccuccaagaaauaugagacuaugugaaaagaccaaaccuacguuugauugguguaccagaaagugacaagugaauggaaccaaguuagaaaacacucuucaguauauuauccaggagaacuuccccaaccuagcaagagaggccaacauucaaauuaaggaaauacgagaacaccacaaagauacuccuugaggagagcaaccccaagacacauaauuguaaaauucaccuagguugaaaugaaggaaacaauguuaagggcagccagagagaaagguuggguuacccacaaagggaagcccaucagacuaacagugaaucucucugcggaaacccuacaagccagaagagagugggggccaauauucaacauucuuuuuuauuuuuugagacauagucuugccaaggcuggagugcaauggcacauucucagcucacugcaaccuccaccuccacaguucaagugauuccccugccucagccuccugaguaucugggauuacaggugugcgccaccacacccagcuaauuuuuguauuuuuaguagaaacaggguuucaccauguuggucaggcuggucucaaacuccugaccucgugauccacccaccuuggccucccaaagugcugggauuacaggugugagccacaaugcccagccaacauucuuaaagaaaagaauucucaaccuagaauuucauauccagcuaaacuaagcuucauaagugaaggagaaauaaaauccuuuacagacaaguaaaugcugagggauuuugucaccaccaggccugccuuacaagagcuccugaaagaagcacuaaauauggaaaggaaaaaccaguaucagccacuggaaaaacauaccaaauuguaaagaccauugacacuaugaagaaacugcaucaacuaaugggcaaaauaaccagcuagcaucauaaugacaggaucaaauacacacauaacaauauuaaccuuaaauuuaaaugggcuaaaugucccaauuugaagacauagauuggcaaauuggauaaacaguuaagacccaucaguguguuguauucaggagacccaucccacgugcaaaggcacauauaaacucaaaauaaagggauggaggaauauuuaccaagcaaauggaaagcaaaaaaaacaaaaacaaacaaaaaacagggguuacaaucuuaaucucugaaaaaaacagacuuuaaaccaacaaagaucaaaaaagacaaagaagggcauuacauaaugguaaaaggaucaaugcaacaagaagaacuaacuauccuaaauuuauaugcacccaauacaugagaacccagauucauaaagcaaguucuuagagaccuacaaagagacuuagacucccucacgauaauacuggaagacuuuaacaccccacugucaauauuagacagaucaaugagacagaaaauuaacaaggcuauucaggacuugaacucagcucuggaccaagcagaccuaauagacaucuacagaacucuccaccccaaaucaacagaauauauauucuucucagcaccacaucauacuuauucuaaaauugaucacauaauuggaaguaaaacacuccucagcaaaugcaaaagaauggaaaucauaacaaacagucucacagaccacagugcaaucaaauuagaacucaggauuaagaaacucacucaaaacugcacaacuacauggaaacugaacaaccugcuccugaaugacuacugaguaaauaacgaaauuaaggcagaaauaaauaaguucuuugaaaccaaugagaacaaggacacaauauaucagaaucucugggacacagcuaaagcaguguuuagagggaaauugauagcacuaaaugcccagaagagaaagugggaaagaucuaaaauugauacccuaacaucacaauuaaaagaacuagagaagcaaggcaaacaaauucaaaagcuagcagaagaaaagaaguaacuaagaucagagcagaacugaaggagauagagacguguaaaaccuuuccaaaaaucaaugaauccaggagcuguuuuuuuuuaaagauuaacaaaauagacagacugcuagccagacuaauaaagaaaaaaagagagaagaaucaaaaagacacaauaaaaaaugauaaaugaaauaucaccgcugaucccacagcaauacaaacuaccaccagagaauacuauaaacaccucuaugcaaauaaacuagaaaaucuagaagaaaugguuaaauuccuggacacauacaccaucccaagacuaaaccaggaaaaaguugaaucccugaauagaccaauaacaaguucugaaauugaggcaguaauaguccacaaaccaaaaacagcccaggaucagacagauucacagccgauuucuaccagagguacaaagaggagcugauaccauuccuucugaaacuaugccaaaauauagaaaaagagggaugccucccuaacucauuuuaugagaccagcaucauccugauaccaaaaccugucaaagacacaacaaaaaaagaaaauuucaggccaauaucccugauaaaccucaauaaauccucaauaaaauccucaauaaaauacuugcaaacugaauccagcagcacaucaaaaagcuuauccaccaugaucaagucgcuuucaucccugggaugcaaggcugguucgacauacacaaaucaauaaacguaauccaucacauaaacagaaccaaugacaaaaaccacaugauuaucucaaugaugcagaaaaggccuuugauaaaauucagcagcccuucaugcuaaaaacucucaauaaacuagguauugauggaacguaucucaaaauaauuagagcuauuuaugacaaaccgacagccaguaucacacugaaugggcaaaaacuggaagcauucccuuugaaaaccagcacaagacaaggaugcccucucucaccacuccuguucaacauacuauuggaaguucuggccagggcaaucaggcaauagaaagaaauaauggguauucaaauaggaagagagaaagucaaauugucucugcggaugacaugauuguauauuuagaacaccccaucgucucagcccaaaaucuccuuaagcugauaagcaacuucagcacaguuucaggauacaaaaucaaugugcgaaaaucacaagcauuccuguacaccaauaauaaacaaacagagagccaaaucaugagugaacucccauucacaacugcuacaaaaagaacaaaauagcuaggaaaauaacuucaagggaugugaaggaccucuucaaggagaacuacaaaccacugcuaaaggaaauaauagaggauacaaacaaauggaaaaacauuccaugcucauggauaggaagaaucaauaucgugaaaauggccauacugcccaaaguaauuuauagauucaaugcuacccccaucaagcuaccauugacuuucuucacagaauuugaaaaaacuauuuuaaauuucauauggaaucaaaaagagcccguauagccaagacaauccuaagcaaaaagaacaaaacuggaggcaucacacuaccugacuucaaacuauacuacaaguuuacaguaaccaaaccaccaugcuacugguuccaaaacagagauauagagcaauggaacagaacagagccucagaaauaaugucacacaucuacaaccaucugaucuuugacaaaccugacaaaaaacaagcaaugggggaaggauucccuauuuaauaaauagugcugugaaaacuggcuagccauaugcagaaaacugaaacuggaccccuuccuuacaccuuauacaaaaauuaacucaagauggaucaaagauuuaaauggaagaccuaaaaccauaaaaacccuagaagaaaaccaggacauaggcaugggcagagacuucaaggcuaaaacaccaaaagcaauggcaacaaaagccaaaauugacaaaugggaucuaauuaaagaguucugcacagcaaaagaaacuaucaucagagugaacaggcaaccuacagaaugggagaaaauuuuugcaaucuauccaucugacaaagggcuaauauccagaaucuacaaggaacuuauucauauuuacaagaaaaaaacaaacaacuguaucaaaaagugggcaaaggauaugaacagauacuuuucaaaagaagacauucauguggccaagaaacauaugaaaaaaagcucaucaucacugguuauuagagaaaugcaaaucaaaaccacauugaauaccaucucacaccaguuagaauggugaucauuaaaaacucaggaaacaacagaugcuggagaggauguggagaaauaggaaugcuuuuacacuguuggugggaguguaaauuaguucaaccauuguggaagacaguguggugauuccucaaggaucuaaaaccagaaauuccauuugacccagcaauuccauuacuggguauauacccaaaggauuauaaaucauucuauuauaaagacacaugcacauggauguuuauugcagcacuauuuacaauagcaaagacuuggaaccaacccaaaugcccaucagugauagauuggauaaagaaaauauggacauauacaccaugggauacuaugcagccauaaaaaaggaugaguuuguguccuuugcagggacauggaugaagcuguaaaccaucauucucagcaaacuaacacaggaacagaaaaccaaacacugcauguucucacucauaagugggaguugaacaaugagaacacauggacacaaggaggggaacaucacacaccagggucuguugggugguggggggcuaggggagggauagcauuaggagaaauaccuaauguagaugacagguugauaggugcagcaaaccaccauggcacauguauaucuauguaacaaacuugcacauucugcacagguaucccagaacuuaaaguauaauaaacaauuuuuucuaccaagaauguaccuacucucuuauugccugaucccaucucccuaucugugaugugcuauucaauuaaauuuguucauuuuuuuuucaaucaguaaaauggcaaagucaguaggacaagggcuuuugucucacugugcaauguuugaauuccaagacucugugaacuaauaaauaccaaaugauuguccuuuugauuuuuuuuuuuuuuacagcacacaccacuacacuuggcuauuuuuaaaaauauuuauuuuuaguagagaugacaucuugccauauugcccuggcugcucucaaacuccugggcucaagugaucuuccugccucagccucccaaaguagugggauugcagacgugagucacugcaccuggccugaauauuuuucaacaaaaguccuuuauauugcuuugguuguuauuuuacuuguuuguucauucauuuauucacucauucauuuauucauuccuguauguuaagaccucaaccaaauuucaaaaaacagccauucuucuuuucuuuagaacaaugguuguucuuauuauuuuuucccaaauguagguuuacauuagguuuacucuuuuuuuuuuuuuuuuuuccagauggagucuugcucuguugcccaggcugaagugcaguggugccaucucggcucacugcaaccucugucuccuggguucaagugauucuccugucucagccucccaaguagcugggauuacagguguccgccaccaugcccgguuaauuauuguauuuuuauagagacaggguuuugccauguuggccaggguggucucaaacuccagaccucaggugauccgcccaccucugccucccaaaguguugggauuagagguaugagccaccacucccggccaguuuacauuuuuacaguugucuaagaaauaaugaaaacucuucugucuucuguaguauuauuuuuagcaaacaacugaaagcaugugaaaugauaguuauagaaauaacucugcugugaguaauccuauucucagccaaugaaugaccuuuuccaauaugcuguuacacaaaaggguacugcaaaagacagagggaaaaguacuugggccuuaaauuccaucggcaacaacagaaguuuccuaguaucaguuugucaagaaagggggguugaucagcauaacacccauacguugggggccaucacaguaaccaauuuguugccaaaugcagcucacauuugagguaggucuuuuaauacgauuuuaaguggcugauagaauugugauuauucuuauauuuaaauaaucucugguggcugucagaacacuccagguuccacaacucuugacgagcacaaaaccuguagcagcuuucacagaauuggcacguuguuugacuuggcaaacaggguguuuaaagcuguuuuuacaaaaguuuccauuauuuuuacaaaagcugcuacagaauuuaaguuuuuucucacauuucaaacguauguguguuuguuuauggacagauaaaaccaaaagaaaaauaggaaagcaucucagguuuggugcuaaaucucuacccaaauagguguauauuaaaaagacuugcaacuagggcuguagaugaauaucccuauucuaauuagcuaaaccaaccuccgauuucucuaacucaaagcuuucuuccagugucuauguuguucagccuguucccgucauugcagccaucuuauaaauacaacugucucuauuugaaauugaacuugaucaaauauuuauuuuuauaauuuuuuuuccuuaaaaauggcuccaauacuguuuuuaaacacuuuuaccuuuaauuaggaaaucagagauggggggaaaaaucugggcccauguuuuaugucccugagauggugaacacuugagggcuuagagggaugcuauaaauugcuggaagauaaagccauucaccuacagacucauugcuuccuuuccugcuuccagcuacaggucccuccauuuccaucauuuuaguuaccuccucucaaaaacuuugggugaaagcagaauuggguugaccucagggccuuuagccauuuuuuccagaggaugucuuuuauaaaggagcagaagcaauagacauggcucauguccuuuaaacuuuccuccuuggaauuuugguuaaaguugaugagacugaauuuuugagccucuaggacccuccucaagaggcccaaugcuguucuagugccccaagagcaagaacaccucaaggauguccgauggauucccagguaguagcccugggagcaccacaugacaggcugaguuaccagccagccuugugacacagccuggcaccaccaguaagaucacuuaaaaauucaucauuucaugaugguuacuaaauauuuaaauuuaauacacauuucuagaaauucuaugaaugggagacugacauuucacaaguucauuuauuaagauguuuaaaggcagguuguccuuaauguaauaauuuucuucagcuucuaaauacaucuugagaggaaacagccuauauuaguuuaucauuucuuaggcccuugaaauuuuaacacaagcaauauacaagacucuuguauaaauauacaauaauuguuuugaaaguccugacuugaaaaauaagguaucucaauccugcagaauuauuauacuuguuuuugaaacagaaagaaaauauaguggcugaaguaguugccccuuuuuauucaucaaaugauaauuagugaagauguaaaaucuggcaaaucaggauucaggaaaugaugcuugcuuguuuuaagcauuuaguaaagugcuaauugucuucauauuuuaagauagcauugcagaccuuuggaugugucugcaaagacugguuuguauuauguugauagcuacaagucaucagcuaucagucggaagacugauccacauauuuguagcugaagguaacguaguagaagaguuuuaauaauaguuaccauuuauucaccaggcacugguguuggugacuuuauauacauuaacucauuuuaucuucaugaugaccauucaagguacagguauuauuaucccuaucuaacauaugaagacacugagacucagaaaauauaaaugauuaucuagagcauacaagucuaguaaaaauggagccugugccaacuccuguccuggacaaaagaacaccugaacucugguuauaagacgagcccagggagguguggaacuagccuaugggcaauaggagucagagcccaggauaaucucaguagagaagcagaggugggggugcaaauucccugaguaccagccacagcaccaggacacagucccccauaggugaagccagcguuucaagacagcuccguguggcacaaaagcuucuguuaccagccugggugaugaagcaagacccuuucuuuauaaaaaguuuaaaaauuugcugggcaugguugggugcaccuauaguccagcuacuuggaggcugagaugggaggcucccuugagcccaagaauuugaggcugcagugagcuaugauuauacuacugcacuccaaccugggugacagagcaagacccagucucuaaaaaaaaaagaaaaaaagaaagaaaccuucuguuauucccuguaugauuugugaagcacccauuagguggcugguacuaaaggauauagagauaaguaggacaggucccuguugucagagaaccuacagucuaacggaggaaacugacaacagaaagaaaucuuagucagucaggguauuugaucauuauaaguguguaugggauugccaaggagcaaagaugaauaggaggugggaguggcaaucagugaaggcuuauuggaggucuuaucuaaucuaaauuuuaaaugacaaguaguuaaacacacacauacuguucauggaccuuguuaugccaccuuguccaagucugcuaaucagaaagaaagauaagaaacaaaugaguguugucagcacucaauauuuuugcuugguuugacuuuguagccauguugacacuauacuugaucuacccuuguccuaaacaacaugcugacuucuugauuagggguuucuauuuugcuuucagugcauuaggcaaugugccacucagguagcagaauuugauuauaguuuucaucauugcuuucugaauugcuguggauuuucucugguguuggcugauaugugacuuuugcaguuuuugauuuggaaaaguuucuuugaggacuagcaggauggacuaacucccaccucgacucuagcuucugguuuuauuuuuccuggccguggcuguaugugcuguguuuaagaagcuuaagccuaugauuacaggacuguuuugucuaagagcugugaggagaggaucaaaagugauaccaucagcuuuggcauuacuagucauuaccuaauggacuuuucagucuucauaacuuucuuagcccaguuaaaccuaggcaauagccaaggaaguguaaaccugcugacaaacuuuaaauucuuucacaaggccaacauacagacaauagcucccugcaucacugacaaccuaaaaccauauuaucuuugcaagaaaguccaauugcuugucucuugaauaagggauuucaguacacaaaacuuacauucaauaugggcaauuuuguaucuuucucaauuuacagguauuauuaauaucuguguagagacaguaucauguauaucaaauaaaaugagaauggacuagauuucuucaaugaaaaugcuaggaaauugagggucagauaaaaauccgaagaacauauaaaaauccagaguauguuuuaaaauagcuguuuuuaaaaaaaauaauuauuuguucauucaacaaauauuuauuaaaugcccauuacaugccugacauuguuuuaggcacuuggaauacaucagugaacaaaauagauaaacuuacuugccuuuaauaccuuuacauucuagaauuauuugcuuuucuuuggagaagucaauaguuaauucaguacuccagcugaccuguaaaguaauguaaauuacacauacagcuuugaauuuuauuuaaccaauugauaaucuuauauaaugucuauaauuguuuuaguuguucuguauuauucaugcauuuaacaaaaauguaucgagcagccccugaauaugaaacaccaagcauauguacaaaauagagacugcccucaggaaauucaguucuguaucagaaauugagacauacacacaaaucacaaaucaccauauagaaauuaguacacgauacauguaguaaagugauacaauguuucuacauaucuaagugagaucuguggcagaggguacggcacagguggaaagaugaaugggcaaucaaaggaugcugcacagaggguaacauuuaagggaccacuucagagugggagccauuauuggcagacugcauugcaaacagaggguaaaggaaaaaaagggaaagauguauuuuaggaauagcaaaauagcacaacuugacuagugcauaguaguacuugaaacuuguaucaauuccagacugugaagagaauugaaugauaagcuccaaguuuguacuagguagaaaugaggggagggagggcacugauaaauuuuugcuauagaaauguccuaaauauaucaugucuaaaugaguaaacuuguaacuugucugcagggugauuagugcaggcugagccagcgugcugugguaguuagaauggaaggacugcuguuugguggcaguugccgugcacagugucuuaagguauaauuaaguauuaucuggaccaauucaaaauggggugauauaggcaaggauaucuguggacuuccucaagaauaccacccacuucauauacauucauaacauaauccugucaaaguggcaccuuuaauaaagaaaaagcaguuauaauuagguauugggaaacuauagcaaauuugagaacaugaaagguccaagaagaggaaaauaucaaaugggaaaguggugauucaugucgcauuaacaucauuaguuaggcaauucugcccaaauaaauaauuuuuauauacauuuuuuacaauacaaguuuauuugagaggauaguuuuaaaugucaccauuuucuuuaugucagauccagaugagugacuaugcaucagcaaacuuugcauuugacaaaugaucacuucuucgcauucaguguguaauagaacaacugguuggauuccucacuuuaagauauaucaacauuugauuccaucaacacuuagaaaaucaguagauuauuccuguggugccaauuuaggcauucaguaaucgcguuuagguuuaauugguaagcuuucuccuccaagugcuuagacaucaaaaagauguguugagcuugcaaagucauaagcuauacaugagguuauuuuuuaguuuggaaguaauuguuuuaaaauacuaauuggacucacugagaacucauuaagaagacaguuaaauauauuauuagggaauaacaaauaaauuuuuuaaaauguaagcuaaaauuuaucucuuaaauucaguugauugcugcugaaauuuugcuauaucuacauuggucuuauuugaauaacaaguugggauuuuuuaaaguauuuaaggauuuugcuauuuuuagugacuuuauuagugauuuaacaugaacaugaaucuuaaccaaggcaugauuuccguaauuauuccuuaagaaucuacucuauuccugugguaaguuaauuauggaucauuuaacaugagacagaaaacagccccuacacuggauagcagagaacuuuaaauuuuauuuccagcauuaccacugauuaauugugacaaugaacaagucacuuaagcucuacauaccucaauuucuucuucuguuaaaaggaaauaauaucugucacaagacauuuucagagcucuuuggaaucacuggcacaaagaaguucaauaaaucaagaguaguauuauuauuacucauccaaaauguaauaaaagauuuuuuaauguaguaaccguucagcucagauuuaaauauaaagucucugaauuuagaauucauuccuacucuugccuuuuagucuugaauguuuacauucauuucuucaagcuucaauccucugaagguaauuauugcauucuucugcuuugcugagaaucguuuuauauuauggcuucccuaucuucuauuuuaggugcuaacuucuucauuuugcacgcccucucuccacccucagaauuuuuuacaccuuuugucucuuuuuuacuuugcacuuuuuauauuuuuauuugaaaauauuucuuaugauuuuuucccuuuaaacagacuauuguauacccugaaauuggcuuucuguauaucugaaaauuaaagucaaaguuauuugccuguccuugaucauuccuacaaacauuucuuacauuacagaggcagguuguauuuuguuaaguaaccagcagaaaagcaacuuggucuugaggaugaaacugagaacacaaaauuaauagcugacauuauuugaaauagucaaauaguaauuaugaauuucaauauuucauaucaagaauauuagccauauagaauuuuuuaguucaucauucuuuuucuucugacagaauuuauuuguggugauaccuuacucauuuauuaaauucacauauauucauagguuugucuguucucuauucuguucuauucaucaguuugucuguuuuugugccaauccaaugugaguuuuaauauuauggcuuuaugguaugucuuaauaucuagcaggacaguucuuucuuuuuaaagguauauuuagcugcuguauauaguuauaaucauauaaauuuuaaaauaaguuugaauucauaaaaaaaauccaccuggaauuuugguugggagaacugauguuguauuaaguuguaucugauacugucuuaggcauugccuguugaagugaacuaguucaauaaaaugauauuuuaaaucauuuuaaauggcaauagaaccuuccauuaaaaaaacucugauucuaaaauaagcaaaagacauaguuccuucauucugucaauggguuuauagucuaauugagaacaucuuccaaaagacaagaauauuuacgaagcaacuugcuaacauuuugguggcaggcaugcugagaugacagaaggaagaggaagucagaugguaugggaugggaucauccgggaagacuucuuggcggaauacuugauuaagucagacuuggaagguggggagaacauggaacaagauaagaggugggcaguuuugaagagagaaaaauagcaaaacauggagaccacagauaggucuccguacagcagcugcugcugagacucaguagggaacggggaaaggggaauuuauuuaucuacaacagugguucucaaucagggccuauuuugcacucucaggggacacuugucaauguuuggaauguuuucguugucacaacuggaagaggagggguugcuacuggcaugugguagguaaggccaggaaggcugccagacauccuacaaugcaggaggcagcccuaacaauuauccagcccccacuuucaauagugcugagguugagaaacccugcccuaaagcuaacucuaccaauccuagcugcacagcacaaucaccuaggaaaacugaaacacaaccaacacuuaggccucacccacagagauucagacugcauuggugcagggccugggccaucaguuguuuuaaaaucuucccaggugguuuuaauguguggccaacuuggaaaacccugcugugaauucuuguaguugaaagggggagacaauuagauuggaggaaauuuuuuuuuguacuuuucauucaugccacuuucuuauuuaugucuauacuuuaaaugacaauacgcaagaaaaugcuuuuggguauggcaaguguguguguguguguguguguguguguguguguguguguguguguuaaaucacuuauguuugaauuaauauauaaaaguaucacauucuccugucuccaucgaaaagagccuaugcucugcuaaaacugacauuuuacaaauaagugcuauaaauguguauuuuaagucaauuuacaaaucuacuaaagcaaacaaaauauucuuaccauuuaugauuggcuucucucuauauuaagauauuuagaaguauaguaugggcacaaacugaauugucaguacuuuugucaaauuauccagcuauuuaguaugauuuccaaauuauacuucuugcucaaaacacugauacaguuugguuucucauguccuggaguuauguuguugauuuugaaaugggcuucuuuuuccaaacuccaaaccuguggagcagcuggugguguuuaguaaccgucugcaccagaagucucaucuuuuuagcauuuaaaauuaauuuuucucauuuuggcacauaaagaacccaagugugccccuuaccucauuaccugaaauauuacaguggcacuagcagugaggacguguggugcagcagcuauuugagcaucagauauaguagcacugauagguuacacauaaggagauuauaccaggagagggccugcacccuuuacuguagaaacaggagguuuauauucacgugguuugcaaauaugcuguaacaaugaauauaacaucaaugguucugguuggguuuucucccacuaaaauggcaaaucucuuuaugcaaaagaugagugugucaugccaaguacucaugauagaugaauacugaauugauccauguaaaaaauuagagcugagcucccagauaaucuggaucccucauggcuaaccgaacccaaaacaaaaauguuucaguuuuaccauaagauaaaaaacuguauuucugguauaguacagagaguucuggacugggagugaagaaaccugggguuugauucuggaucuaccaggcauguuguuuaauguucucuauuuuaugaucaccaggcacuaaucaucccucaccuggaauucaguagaaaaaugcccccaacuaguguuccgaacuccaguuuuauucuucuuaaauccaucuuccacucugcugccagcaugaaccuucuaaaauauaaaacuaauccugucacuccccaggccaccgaguguggcugugccgacugagcuucuucuaaagauaucguuugaugcuuuuuauccccugggucuucauucaugcuguccuuucggccugaaacauauuucuucauuccuuuauuccuaguuaguccuccucauacuuuaagaugcaucucaggagugaccucauccagggaacuaucauauuaggugcuuuuccuuaggccuaggcuuccuguugcuucuauuaaaauuaucgaaaaguaucuguuuagguggugguccuccuauaaagacaguaauaugcucuucaaagacagauaacugauccuaauuaucuuccccugaugccuagcauaaugucuggcaaagaauaggcauucaguagggaagaguauggaaaggaaggaagaaagaagggagaagaaaaggugaggagagaaaaggaaggggagagguaagauugaguaaguagagauaaauggguaauauaggauagaaaaagaaugggaagaaaggcgggaagaggaaugauggaugaugcaguugguccacccugauuuuuaagaucuaaccgacuuaaauauuugcaauucuguaccauuauaauauuccauuuaaacacuccucuuaccaugguauuuuguauauuguggcauagucauuguuacauuauucucuggguuucaauagauugucuagcaccggaucuguaguaaaggagcaaaaucaagaccaugagcuagacuuccaaaccucucuaaauuuugcuuuuucucacuaaaagcaaaaguuacugaccuuauuuuaaguuuuuuuguaguucauauuagucucuugauagcuccaaggcagcuuacuuagauauuauauaccacauaauguauaaauaggacuuauuuaagaauauaugaguaucuaaaaauuuaguaaauuuuuccuacagccuguuacuaauucauaguuuauaaucuuucauuaauuacaauauaggugcuuuacaacaccugccuuuuaaauggcuuagguuucauguauaaaauugugacagggcagaauuucauauuguauuuugauaaaaauaaaguaauuguauugaaauagcuaauuuacauaauaugaccauucaauucccauauuaaguaaaguaaaggugagagagaaaucuguaauuuacauaaugacuucccauaaagagacccacauaugggggaacagaauugaaauuuaggaaaguauucagauaauuugagacaaaacagaauuaucauuuaaugaugcauauagaacuucccauaucugaaaaagguacauuucaacuucauuuacugucaaaaauaugacuuaagaaguagugaucauucaggauagaaguuauuuccaaucacaacaaaucuuuguaaauacaaguugccuaauuuccugugcccacagugcuacaagaaacacugauggagcucugaacucaggguaccugacuaagaaaaaggcuaacucaacaauacaacuuagugucaauccaugucauuuuuuaaaaaaucccuuaucacaaaacacauagauacuaucuuuuucaguuccuugaaaaauguagcaaauauucaauaguauuuguugcuuucucuaaauuccaaauuuucauacugaauuuucuauauggaauacuuauagcucaaugcaaacaaauugugaaauguugcaagcaggaaugccuuaauauacuuauuuccauuguguguuaaaauugauugcuagaggcaauuuauuuuuucuaauuuuuauuuuuugaaauuuuacuucaaguucuagcauacaugugcugaacuugcauguguguuacauagguauacaugugccauggugguuugcugcaccuaucaacccaucaucuagcuuuuaagccccucaugcauuagguauuuguccuaaugcucucccuccacuugcccccaacccccugacaggucccacugugugauguuccccucccuguguccauguguucucacuguucagcucccacuuaugcgugagaacaugugguguuugguuuucuguuccuguguuaguuuguugaggaugaugguuuccagcuucauccaugucccugcaagggacaugaauucguccuuuuuaugacugcauaguauuccacgguguauaugugccacauuuucuuaauccagucuaucauugaugggcauuuggguugguuccaagucuuugcuauuguaauagugcugcaauaaacauccaugugcaugugucuuuauaguagcaugauuuauaauccuuuggguauauacccaguaaugggauugguggguugaaugguauuucugguucuagauccuugaggaaucgccacauugucuuccaccuucugcaaugguugaacuaauuuacacucccaccaacaguguaaaagcauuccuauuucuccacauccucuccagcaucuauuguuuccugaguuuuuaaugaucaccauucuaacuggugugagaugguaucucauugugguuuucauuugcauuucucuaaugaccagugaugaugagcuuuuuuucauguuuguuggccgcauaaaugucuucuuuugagaagugucuguucauauccuuugccuacuuuuugauaggguuguuuguuuuuuucuuguaaauuugauuaaguuccuuguagauucuggauauuagcccuuugucagauggauagauugcaaaaauuuucucccauucuguagguugccuguucacucugaugauaguuucuuuugcugugcagaagcucuuuaguuuaauuagaucccauuugucuuacuuaccuaccagguagguaguaacuguaccuuauuaucucauucaguacucuguuuuauuucugguauugcucgccuggguugugaacaauuaucagaaauaaaacagaguaucaaaugagacugaaaaaucuuaccuuuacucuuggagagaccaggauggauguagcauguggguuucugaacccuacaauuagacacuuacccacuuaggcagaucucaagaaaaagaagaguagaguugagcaaugccugcuuaguuauuuccaaacuugccagugggcuaagccacuccuccuggcccugaacagagugaguaaagaggcggagagaggccaaaagugugcuuaggaaaagaauucucauuuuauggaaagcaagggcugguuuuucuaacuccucugcagagaauaaccacuccucugcagagaauaaccaaugccuagccauaaggcuguuugauagcaggcccucucuauuccugcuaucaaagagccuuugauaagaauuaaauuuauuuaauaauuaaauaauuaagaauuaaaucuuaaucaaucuauuucuuauuauccagcaauaaugaucauguugacauuuucuaaaaacacuaugcagacauuucccaaaacuaguccucaucaagcugacaacggucucaccaauuaauaaugucugcuuuuggggauuuuuuugguacgcccccaucugauauuauaagcggcauagcgauuuuaaucuaggcuugucaaaucccacacucuuucugcuacaccucuggcuucuuguaaugaauggucuugcauagcuaauguggucuuuuccauauucuaugugaaaucacccuacuccaccaauuucuccuuucucaggaaagaagucugcauuaguuaaaaaaagaaaaccaaccugagcaauugggaaggacacuagguaaauauuaaagaaacagccauaaagccaaaugcaacuuuaaaacaauaaauaacacaaggcaggauauugagcaauauuugccaugcccguaaccacucacauucuuagucuaauuuucuuuccuaguuuauguucuuucauuagacugugaguuagacuucuauauguuacuacacacuuaauaaagauauuucacuuuuccuggugugcuuccagagaccuagcaugcagugaagguuuuauaguccugugcagugcagcagaugucauuccauuugccuaaguccugcugacauuuggagauguggauuaauugagcuacagaaugaaauuuaauuaaaauuaaauacagacuuggccauuguaucuguucauuuccugcacucuaguauguguauuugcaggcagcgccauaguuaauuuguuuaaucaggaugcucugugggggaagcugcacuuuguuuuacgcugaaagacugagggugugguggaugccagguuggauuucauuacacacaaugcgagcuguguaaaugaugcuacugaugagccucaaaggacuaccugagggagcaagguggcuccauaugaacccauagagagacaacaugucauagacaacauuuagugaugucuuuuaaauugacauuacaugaccacagaaaucuugucuauuacccauuaacauguugccauaguauuuguucacucaaacauucauucauucauucauucaacaaagauuuuuuugaguacgaacugugugcuagguccugaguuuaagguaagcacuauuauuaauuguaaccauauucuuucuaguaacuccaauuggagagguugcuacuucuuuaagauauauuuuuuagaacaagauaauauaggcuaucuaaaguuuaucucuggaaugaggagaaacuauauuacuuuauguuuuaaugagauuguaucagggcaaguugcauagauccuacccuuccuuugauauccauugcaaagaucaccuccuucuggggggcuuucccaauuccugcaguggaaaaugaacucuauuccaacaacucuccgaaguacacagaaguucuuuguguuauaucuguauaucuagauuauaagcuuuuugucaacauccucuuaaucuuaaaaaauauguaggcuagugcaucauuuccagaauguccuugaagacuauuucuuagauugaauauacuguauugucaagcauauguguuccuugguaguggaccauuacuguuuuggcagucuagcgucauguuuuccuucugaggcaauagcacaguaccucuacuuugacaaaucacuucucccaccccuauauaccucagguaaaggugagugagcuggagccugagccaaucaguguauuccaccccucuguuauugguucagaaauggucacgugacacaagccagccuagucagaaccaauacugcuacaaucuaaggccucgguuucucuucuguuggacaugaaaggaugaagcucaugaguucccuuuuucugcaaggggagaauugucugaaaauggaggcaacccaaaggaagcuacagugaaguaaagagaaucuuguuacucauccguugcugcuuuguuaucuuagcuaaugaguuuuugcugaaguuggucugaauuguuuuauagaaagguuuuauagauuauuagcaugccagaccaauuucuggcuguaguaugcaaaagaaccauaccugaucagccucauuauggcgaucauuuauaugacacuugcuauucuguaagcuccuuaaggacagguacauuuccucuuaucuagugacucaguaauuagcucggagccuggaauagugugugcucaauaauauuauuuuguugaaauuaaagaauaaauguaaauucuggugguuauaugacaaugucaaugaauaaucuuuuuguaguaaaacugcuaaaauugacauauugcucacaaacccuuucacuacuuuuuuguuuugcucuuguucguaugacuaaaaggucacccagcaauuucuaagggugaaagagauaguucaaccaucucauauuaauaaccagccuuaugucaaaaacucccugaaaaagaaacucuacaaccccauuauguuauguaugccaauguuaacuauucuuaccaccuagacauucuucuuuauguucccugcaugauacauagagauucugaguccucauaaauuccaaaguaagcauuuucucaguugagcuauauugcuucuagcuauugacucucaaauugguucaaaucaaagagcacaccauguucuuucuggcacauauuuucuauucuguaccaauuauaccuauuucauauggacaauauucuauuaguccuuggaguuauggcaaaauaagcuuaauauuuuuuucuccuuguauauaucuuuugugaauuuaauccugcucuuuuuaacucucauuuuccacagacacaguaauauugauaagguugacaacuaaaauaauaauuaacauuugguaagcauuuuuuuuuaaccuccuaaccauuacaucaguccucacaauaaaauaggagauaacuauucuuauccccauuuucaacauaagaaagaugaggaggcagagauuuaaaccccaaucaccuuuaagaaauucgcugagcuguaggacauagggaaacuuaggaagaauuuaugauuuugauagauaaacauuuuaacuauucuauuugggacacugaaaccuccaaaaggagagauggaguaauggggacagaggcugaaaaauuucuuauugcguacuaugcucacugucugggugacgggaucaguaaaagcccaaacuucagcaccaaacaauauacccuuguagcaaaccugcacauguacccugugaaucuaaaauaaaaauggaaauauaaacaaauaaauaaaauauucuauuuguaggauacuguuaagaaauguucccaguauuauauuuucuugauuaauaugagcuaauauuaauaaaugccucuccguacacauauacacacauaauagcuaacauuuuuugaguucuuacuaugugcaaggcacuguaguaacaacuucuguaucuguuaacucauuuaauacuugcaacaaauuuaugagauaaguacugcuauuaucuucauuuuacagaugcagaaacugagcaaagagaaguuaaguaacuuacuuauacaagaucauaagacuaguaaaugguagaaccagaacuugaacacaaaugccacagcugcaaggccacccugcuuauccauauaggacaauauuuaagaaagcaauuaauuugcauccuaaauuuauugucugucaucuuucagaguaucugcccugugcuagucacugagcuauguucugaggauacugaaguaaacaagacagaaggaggccuuuuccuaugaauuauguuccauacauacacugagccaaucaguguauuccaucccccuggcaucugugauugguucagaaaugggaacaugcccuaagccaugugcaagaaacacaaacauuucuuugaaauaagcaacaaauuauauuuuaaaucugguaaaguucuaaacuguaauaaguuuugccagauuuuucccaagucaggaauuauuuuuuuaaccugcuugaucucauugaagacagaugaguaaauuauuagguuggagaaaggaacauaaauguucacacauuuucuauguguugaucacuucuggacauugguugcuugacagauguggucaaaagaaauaauaaaauuuguauuaugucuuguuuuuuacuuaaacuuuuuauuuuuaauuuuuguggguacauaguagguguauauauuuaugggguacaugagauauuuugauacaggcauacagugcaucacagucacaucaggguaaaugggguauccaucaccucaagcauuuauccuuucuuuguguuacaaacauuccagugauacucuuuuaguuauuuuuaaaugugcaguaaauuauuguugaguguagucacucuguugugcuaucaaauacuagauauuuuucauucuaucuaacuauauuuuugugcccauuaaccauccccaugucccuguccuccccccacuacccuucccaacuccugguaaccaucauuucuacucuaucuccaugaguucaauugucuuaguuuuuuuuuuuuuuuuuuuuuuuuuugcuccuacaaauaagugagaagaugcaauguuugucauucugugucuggcuuauuucacuuaacauaaugaccuccaguuccauccaugcuguugcaaaugacaggaucucauuuguuuuuauaacugaauaguacuccauuguguauaugcaccauauuuccuuuauccacuugucuguugaugaauacuuagguugcuuccaaaucuuggccauugugaauaaugcugcaauaaacaugggagugcagauaucucuucuacauaaugauuuccauucuuuucgguauauaccuuggagugggauuguuggaucauaggguaggucuauuuuuagguuuuuuuguuuguuuuuguuuuugaggcagaaccucacucuguuacccaggcuggagugcaguggccuggucucagcucacugcaaccucugccucccagguucaacgauucucccgccucagccucccgaguagcugggauuacaaguaugcaccaccaugcccagcuaauuuuuguauuuuuaguagagacaggguuucaccauguuggccaggcaggucucgaacucuugaccucaggugauccacccaccuuggccucucaaaguguuaggauuacaggcaugagccacaaugcccggccucuauucagaucuuuugaucauuuuuaaauggauuauuagacuuuuuuccuauagaguuguuugagcuccuuauauauucugguuaaucccuuguuagauagguaguuugaaaauauuuucucucauucuguggguugucucuucacuuuguugauugcuuccuuugcugugcagaagacuuuuaacuugaugugaucccauuuguccauuuuuucuuugguugacugugcuuauaggguauuacucaagaaaucuuuacccaguccaauguccuggagaguucuuauaauguuuucuuuaguuugaggucuuagauuuaagucuuuaguccauuuugaugugauuuguuguuguugugcacaaugauauaauuucaaauuauaccuuuucaaauugucuaguaaaauauauuucauauacuuaauacuucuauuaauacauuuuucuaaaaaaauacauuuuucuucuccaaugcaauagauuucccuucaggucaguauuacccauuaaugcagaguuugggggaaauauuauuccaacuuuguggauauaagccagauugagacuuaauaucuugucaacccaugauaucugcaccuuuuauauuugugauuucauucuuuaugagcaaugccaaaacucuauuuuccccuuccuauauuguuuuaucuccauacauacauuuauuuacaucauuauaugugucuguauuuuucuuucugacuauugagucauaguaaaaugaguuauccuuacuuucagauuguuauaagaaauuccccccuucuccauuggucugugauacuaccuuucucuuaugcuaaaucucaauauaucagagucugcuuuugaauuucccauuuugaaugcuccauuauguuccauaauggaaacugguuugucucucuauucauguaccaauacugcaugcaccaaaaacuauggccuuauaauauguuccagucucuguggguagaaucccucaucguucuuuuugcucaggaaauuccugaaccuucauguuuguucuuuguauguggugagagacagaggcuuaguuuuauucuucugccuauggauauccaguuuucccaguaacauuuauugaagagacuguccuuuccccaauguauauccuuagcacuuuuauugaaaaugaguucacuagauauguggauuuauuucuggguucucaauuauguuccauuggucuaugugucugucuuuaugcugauaccauacuguuuugguuacuauaguucuacuguauaauuugaagucagcuaaugcaguuccccaguuuuguucuuuuuauuacagcuucaaucucauuacuuacuauuguucgguucagguuuuggauuucuuugugguucaaucuugguagguuauaugugucuaggaauuuauuuauuucuucuaaguuuuucaauuuauuggcauguaguugcucauagugaccucuaaugauccuuugaauuucugcaguauuggcuguaaugucuccuuuuucauuucugaauguauuuauuugggucuucuuuuuuucuuauuuagccaggcuaaagguuuguguauuuuguuuaacuuuuuuaaaaagcaaguuuuuguugaucuuuuguauucuuuguuucaauuucauguauuucugcucuaaacuauuucuuuucuucuacuaauuugggguuugguuugcucuugcuuuucuagcucuuuacgaugcaucauuagguuauuuauuugaaguuuuucuacuuuuuugauguagcugcuuauugcuauaaacuuuccucuuaguacuguuuucacuguaucccauagguuuugguaugucguguuuccauuuucauuuguuucaagaaauuuucuaauuucucucuuaauuccuucauugacccacuggucccucagaaacauauuguuuaauuuccauauguuucuuauagcaacagauagauggauuuuuaaaaaaaauuccauucagccacucugugucuucugacuggagaauuuaguccauuuacauucaauguuauuauugauaaguaaagacuuacuccugccauuuguuauuuguuuucugguuauuuuguggucuucucuuccuucuuuccaucuuccugucuucauuugagugaaguucauuuucuaagguaguauguuuuaauuucuugcuuuuuauuuucuguguaucuguuguaugauuuuguuuugagguuacuaugaggcuuucaaauacuaucuuauaacccauuauuuuaacugaugacaacguaauguauuaugucuuuacggagcucucaguaaagagacuaauuuugauuauuuaacgauggcaccuuuaggggaaccauagucuaguucaucuuaacauacaauguaaacuagcauauuacuuuguauguaauagggacuggauaaauauuugcaagaugaaaaaaauagaugaauaaagauaggacgacaguuuuuugacaguuuugcuaauuuuaugcuuccuuuauucaacaauauugagcaccuauuaugcacaugacacugugcuguggaauuugaggggcauaugagcagcuuccaguuuauacuggagauggaagaagcaagguugcacaagaacaaccagaaugccagguugaaaacaucuauuccauaagagauauaaaucaaauauuaggaggaacucucagagaaaaagaugcuuagugagaaacugggugccauuuauccaucagaguaacacauuuuucaagauugggcuccugaugucuaucugugcagguguaacucaauagauaggcagagcaugaccaguaauccuuuucucauagaauacauucuaaagauucuccuuugauuuggggcugcagcugcuaguggucucuucaucucauuuggcccacugccuuugcucaaaaagagccaccguuucuauuuguggcauagcaaaccagucugugucugcugcugugguuucucagcagccaacaacuuugccacauuauuuugaaauuguaauccagugcccccuugaaguauugcucccgcucccuccucuugcaguugccccacuucaccaugcagcagcugcuuguguauucugcugccacuauuuccaacacccagcccgcccagaguugugugugacagcucagcuucaaugcuaguaaacuggcuacuuuccaguauugucauucagacuuccagaaaacauaccaugauaguaauguucauaacugauacuuucuaaagccaauuaaagggaagucugagaauuguucuuaaaaaucucacuugauauucagaaccagugcaagcugaaggagguaucuacucugugaguccucuuuuaauugcaauuuuaaacgaauaaucuugcuucuguuuuuuuuucaguccaacacauguuuauugaauaaacaaauguggugacuaaaucacagaaauuaacauaaaaauugacaggcuacuaagaacauauagaaaccauuaaagaaugauacauauuauaucccacgucuguguggguauugcaguaacacaggcugcauagacugcuucuacuuugccuaauuguggguccuaaugaauguuaccugcaaacuuaacauauuuaucuguccaugaaucaaagcuauaggcaugcuacuuucccauucugaaauacagaaacaaagagggaaaaaaagagaacguaaaaaugaaacaagaaaaugcucauguaaggagcaaagaggugccuggggaggagggagguaauugcggaaguagucaagaaccuggcauacuuuggcacaaaacaaauauuucugaauaaauaaauucauaaaggagugguaauugauaugacgaagucuaauagggaaaguugaggucuaguaauaugaaaaguuguaauuuuaaccacuaacucucuugggugugauuaacuuaccacugagugggucuuucuuaaucuggcucagugauacacacgguuucacuccccauugucuuaaaaacuguuaagguuugaaccuugugcucaaggcuauaugccugauggaaggaaagcaaccuguauuuaaggaguuuaggaagaccaccagaggaagugaugcuccaguacagagugcucaauaaauauguugauugaguccacuauaaauucauaaucacaaucucaaauaagccaacaauccugaccaucagucucauuaaaauccacuggcuaacucacccacccacaucugcaaugauauuuucaaaccuucucuauugcuuccuuuuguaacugagcuucgguugauuugucuccaguggaacaccucauugcuuccuggaaaggauuuaauacuuacauacuucucaguguggugacaaguaugguaauagucaagcauuugagacagagugaacagaaaacugagcacccagucaccuaacuaggcuuguauaaacaacaccuuccuugcuuccuuuauauugcuucaugggauucauuaacuuaccagauauuuauugaacaucuacuuuagugguucucaaauuuuuggcccuaaggacuaaggacucuuauauauucuuaaaaauuauugaggaccccagagaacuuuuguuuauguagguuauuuugauuaacauuuaucauuuuagaaauuaaaacugagaaguuuaaaugugcugaauucacuugaaaauaacaauaaaccaauuacauauuaacauaaguuauguuuuacuaaaaaaaaacuguauuucccgaaacaaaaaauuagugaugaguggcauuacuuuacaguuuugcaaaucucuuuaaugucuggcuuaacauagcuggauuaucaugucugcuucugcacugaaucuguuucauauguugcuuugguugaaggauaugaagaaaauaugaccucgcacagaaauguaauuggauaaaaaaggaauauuuuuauuaccccuucagaucauuguggauuuuuuuuaauacagcaccaaaauucaacaaaugguaguuucuuaaagguuaguugcaauguauuacaaaaaucugaaaugauaucuuguacuuugaauuggucuuuuaccacagaagauuuaugacaucaugaguuguuaauuuggaaaauauuugcuuacugaguuauacagaucuucaaauguugauacauuucauuacacaauaucacagaaauuguaacuguuaaucucaccacugaucucaucugaaaaaucuuuaaauauuaagaagcugucaaaguuuaugguagcagauacaaaguuuuccaaaauucugauuuuacuugaaugcuugaauuuuauuauuggcaacaaauauugucaguuguuuuccuugaaaugacaguuuuacuauguuaauuucagggaaaauaucugccaaauaccugucaguuguuuuuucauguaaaaaaugguauuccaugacaaaaguggcuacuucagccuuccacucagucacacaaguacuuuuccucuagacaaccauuguacuuggguaugcagugaaaugcuuuauguguacuucucauuuugucacacagaauauuaaaaugauguauauucaagaaucaagauucaauaaaauugauuuuguuuuugcugcuucauaagggcauuccugagacuggcuuuuauuuuuuaagguuuguuuguuuguuugcuuguuuugagauggagucucgcccugucacccaggcuggaaugcaauggcgcaaucucggcucacugcaaccuccgccucccggguucaagcaauucuccugccucagccuccugaguagcugggauuacaggcaugugccaccacaccuagcuaauuuuuuuguauuuuuacuagagacaggguuucaccauguuggccaggcuggucucaaacuccugaccucaggugauuugccugccucagccucccaaaguguugggauugcagguguaagccaccgcaccuggccuauuuuuuaaguauuaauauaaguacguggcagugaagaauacaaugaguacuaguagagugaucccacugcauugaucccugcaaaggcaucagcgauuuuacuuaccauuggugcaaauuuuaacacagugaaaaaggcaaacauuuuaguaguaguauaaaaauugcuuugauuuuguaaaugccugaaauggucuugggacugacaacaguccacaaaccucacucugagaaucacugacuuacugucugcauagaauagugccaaugauaacauuaaacuaaaagacaaagcaaaacguuaugacauaguaaccugccuucaaaaauuuauaauuaaguugaaugacaugaaauuguuauuuuuguaggcaagcuugaauauuggcaauuucauaucgcugaaccuauagaauaaaauguguguguauggaccgggcacaguggcucauaccuguaaucccagcacuuugggaggccaaggcgggcagaucacuugaggcuagaaguucaagaccagccugggcaacauggaaaaaccccaucucuacuaaaaaugcaaaaauuagccaggcauggugguacgcgccuguaaucccagcaagucagguggcugagccaugagaaucacuuguaccugggaggcagagguugcagugagcuaaggucaugccacugcacuccagccugggagacagagcaagacccugccaaaaaaaaaaaaaaaaguauguguauguauguguaaugaaacaugucauauaaaccauguagaucuaagggaaugcaaaauuaguacacaaccuacagaaaaugcagagaguuauaaguugagaggagacagguauuuagauuuuuauacaguugggagauggaacucuuuccaaguaagggaaauaguguaagcaaaaguucagaaauugacaugaaugcaaauaaaagauauuuaugauguacaugaggcaugaaguccuguuucugaggcuugaaagauaaagaaaaaauuauacugggaaaggaacagacaauuugaaagaguucuuuaauugccagucugacaaaguuaacuucgaugcagaaaaacaaagccauagaagguuaucuauucauucauuuaacacacauguacuaagagauuaccauguaccaaacauggugcuaggcacucaaggaaucgaagaacuuauuguuuaacuauugaacuuaaaguuuggccacugaaccaaccuugugcuucaaucacauaguaguaaagauccuaaccggcugaucagaacacauuauuguauguguguuuaauguguuaucagaaugcagaugaaaagucaaucaauucagcuugggggcagacagaaaagauuguacguuaagagaugacucaugagauugaauaagaggaauaauagaaauuggccagauagaugugggagaggcauauucuggguuggggacauugcacuggcaagggcacugugauauggaaaaaccuggcacaguuugaaaauaaagagugguucauuauggugagaagguagaaguaaagaacagugugguuggaguuaagacugguaaccucaaacuagauucagguaccaaugaucccuauauucuguacuuucguaauucacugaggcuucuucuuaugaggcuauccuagcagaucugaggaugguccggagguggagaugcugcaggccuggaaaacaguaguuacaaaaguggacguauccaagcuggagaugcugaggacuagaaucucugcagggcaacaggcauaaaaagagagcaauuuggaaacauuugguggaagaauuuguaaaaauguguuaaacaauagugcaaaaaaaaagagagagagagagagacauugaagaaaaaggucuuggcgaaagagaacaaguuuguuuggggauguguugaguuuccuguuggaaacucagaagaaaauucaggacuaaaacauacacucaggagucauucacguacaggugauuguugaagaaaugggagcaaaugaucaccaauguagaaagcauauggaguggaagcaggagugccaaaacacaugaauccuguucuggcaggugucaggagaaaauggaucuuaagugggaaagaaugaaguaagaggucaaauguuucuccaaacaggaaauaacgaggccuagguucaggagaugggucauggaggugaagugaaaggggcacaucugacagaccauuugguagaaagaaucuuugagaacuugguuaccagaauugaaagaaaaaaaugagucagagaacauuuguguugcuacaucuagauuuagaaaaccaguaggucuuccuaugcuauuuuuuuucugguuggaugucuugguuuuuauauuucuuucaagacuucugaaguaccuaguggucuagaaccuaacaaaaccacccugaaagcuggacaguuuggggcaguauguauagcucagcaauguuucugucccaagcuucauagaggacaaugggaaccucuucuaguuuggcuucuggguguccauuucuagggagcauaguaacacuagacugggucugaaauggaguaggccuagggugcggagguagagaagacugugucucccuuugaggggcacaaagaaggaaauaaauuuucugggaaacuauaucuccacuucauacagccccccacccccacagucgugcuuacauucuuacccucacuuagaaagcccuucaucaccauuuccaucaaugagagauguguauguauccuuaaauuaauaaggggacauagauacacaaacauauacguuuuuacacaaauaaggcauaucgaacgaacuguugucuuacuuuuucuacuugacaguguaacauagugauuuuuccauaugacuacaugaagauccaucuuacucuuuuuuaaccacuuccuaauauuccagaaugauauggguucccauaaauuauuuaacugaaaccaaacugaugaauauuuaucuuccauuuuuacuaaaauguaaaaguuauugcauauuuguuuaucuuuguguagguauacuaauauuucuggguauauuucuguaaguguaaaagccugauuaaacauaacuauuauuuaaauuuuuauauagauaaaaauguuuaaauuuuaucauguauuccaaauuuccuuucaaagaggcuaugcuaauuuauauacccaucaauaguauaugacagggcuucuuuuccccacauuuucaaacuuuuaaaucuuucucaauuugauagguuaaaaauaucuaauuuuaauuuguauuuccuuuaggaaugaaguuaggcaucuuuuuauauucuuauaauccauuuucuuuuuauguaaauuggcugcuuaauuccuuugccuauauuucuuuuaggauuuguaagaauucuuuauugauuagcaacauuaacucuuugcuauauguauugcaaauauuuuugccacuuuaugaccuauuuuauuuuauugggguauuuucuucugagauuuuuuuaaaagaaauuuauauacucauauuuauuaguauuuuccuuuaucauuuuuaugaaauaguuuggaaggaucuguccuacuguaacauggagaauagauugaaucagggaaggaaaaaauccaaccaggagacuguuuaauacuauacagaaaugaugggaugguggcuugaauuaggacaguggcagugggaauagauggaaaugaacauguuugugaaauaggaaguagaacuuggagacuggcugggugagagagggaagagauauguucagggaugauacacagguuucugguuuggacaacaguauagauugguucacuaagauggagagcuccugagaaagaauaaauuugguuuagggaagagacuagacuauuuuauuuauuuauaauuacccuauuaaggcuacguagaacuucauuuuaaaggugaccauuaucaguuuguucuuguuuucuuaucucucaaucuaccaacaucuauuuuuauuuaaggucggccuuucucaaugcaacuggguguuuucauucuuuuucacagagaaauaauuaagugaaacaucucaggaauuuuauuuaauauuucuuaaggauuacagcugcaucccuauguauccagucaauaacauuauggaaagauuacacguuauuuuauguauguauguauguauuuauuuauuuuuaauuauuuuuuuugaaacagacucucacuccaucacccuggcucuagagugcaauggugcaaucuugacucacugcagccuugaccuguggggcuuaaguuuuccucccaccucagccucccaaguagcugggacuauaggcacgcaccaccacgcccagcuaauuuuaaauauuuuuguagagaugguggucucacuauguuacccagucuggucucgaacuccugggcucaagcaauccucccaccucagccuccaaaguccugggauuacaggugugagccacugcaccugaccgaauguuauuuuaaaacugaauuuugcuguuaucaaauauucuacccuguauuauuuucagaugagauaagaaaaauggaccaugauuaaaacaaaaaauauaacauuuuaauuaacuugaaaauggaagcuuagauuuuugguguuuugauuuuauacuaaaaaugucaccgaauucuugcuguuguuuuccuuugcaaaauugccacuugcaacuccuguuacuuuagcugagugccacaucauaccgacuuaaugcugcugaguucucuucacuguaauugaaaucauguuaaaggcagauauaguacuaaugugaacugcaaauaccucuucauucaagaagaaaaauuacaauaagcagcagagaccaaauuaacugucuuucuuguucuauaugguauuucuguaaauaagaaauauacugaugucgaacauauucugacuucagaaacuuaucaucugaaauaagagaccuccagaacuaguuuuggaaagacuuuuaaaccuggacaacucccugauguuaugaagacugacagugcuucugaacucuaacaaggagauuuuauauaagacuguucuuacuggaaccuguuuuauguaagaacauacuuaaaaagcuaauuucuuuucuccuuuuugcacugcaauccacaaagugugacuaauaauagauuuaaauuugcuaagugcauucacuccuuugugccaucauaaagagaaucuauuacuguaaaauugaggcuuaguuccaaauugcgccauuaugaaguuuucuuccagcaauguuuugucucuaauacacuucccucauuguaauucuauugcaaaccugaugucuagcaucaagucucacaauaauuauuuuaaauugcuacuaggaacaguaguccuggugggauauauuacuaccauucuaacaagaugaauuucaaugcacuuguaaccauauuauaguauauuaugaaaggaagaaaaucuuugaguuuuauaucuauggacaugcauguaacagaaaaaauaauucuuauaaacuucaaaauacuuuauauugaacuuccacuuaaacuaauuauaagucacaaggacaaauuaggauauucagccacauggcccauuaauggcaugcugagugacuugaagugaauaaauaauuauaaauauaaaaauauuagcaaugcuacugcuuagauuaugcauaguaauauauuuauaugauagauuuuuaaagauaauauaaauuagauugcugcaggauaaaggcaccaaaaaacuauuaaaaaugaagcugauguaaaacuuuauccuuaauuuaaucuuucccaaggcuugaggucauauaaauaaaugaaccacuccaaaaaaguauguugaaaaauaauuuauuguauaauggaaacuauaaaaaagucauucucaggagucuaaaacauugagucuccaguuuacuaauagacuauagaggaaaauacugcuagggaucaacaaggagagcacaggcaagcauguuaagucucccugaaacuuaggcaauuuguuuaacaguaguguuacacaauacacuguguguuucaugaguuauuuuacauucuuacugagggcauucuaaaauucaccuuacuaauaaguugccuacaggcuuacaaauaaacugggaagaugaucacuuuucaauucacugaaagugugaaucuugaauuuggugcauaacaaaauuacuguaaagaaacaguagagccaaacuucccuguuacagauaaaaugauuauaaaaugaucugagaucaaagcuauuucagucuuaauaauuuaaauaaguuggcacacaaaauuuagaagaaauuccaaguaugaguucuguaacugcaggaauucucuuaauaauguucauauaacacuacaaaugaaaaaucacuuaacuaccuagcaaaauugaaaguuacuccccggaguggaccaaauugggaaaaguuaaucugcauacuuuacuaaaaggggcaguugaauuuacaugaacaauucagcauuuuaccuuaaauaauaauugaaugaacuacauuacauaccaaccagcauggagcuaccaauggagucgugagagauuaccccaaaauggcauagcaaccuucuauuuauaauaaagugguucauuuuuaugcaauaacaaccauucuguagcauuuacagcauauagaacaaucuggaauuagaucauccugucuagucauuaccuuuuagaaacuaagaaaguugucuuuuuaccauuaggucaucucuaaaacuuuugguauugcuuuguagcuuaguugcaaucacuuuucagugauguagaccugaaaucauauacuuuuguuucugaaacaucaguauuuguuaguagaguuauuuauuuuaugugucacuaaaauugcauuuacuucuauauuuauaguuacuccuuuauauauaaguguauauuauuuuaaauauacuauugauguugcugggggaaaaacagaaccuaaggcaaaaauauccauuguuaacaauguuuuuggccauagaucuauucuccaaguggccaaaugccuccacauuauucuauucuauuggcaaaugccuuauucuauuggcaaaugccuccacagaacuaagcauaagacuucaccucccacuuucagguuaggggaaaagaaguccaaguuaauagaaaaaugauuagaaacagaaggcgucuugacucucaguuuuguuaaugauaaaaaaauaaacucuccuaaaccuuuuauaaauuuccaccaauacccuuccucuuccucuuuugaauuaaaaacuuuuuugugacauccaaauagaaacaguuguccagaagagcauaugaauuuaauguuuccccaagagcaugacugaaaaaagaugcugacccugugcuuaucaaugccuuugaaaucauuacugauuuuuaaaggacaauaaagaaagcuguuauucauuuuaacaucauacacgugcuccauacauauuucuuuuuauauuuaaaaauacccacauuuguguguuuguauuuauuuagauuccuuaaauuucuugacaagagaauuuugaacuaacuccuuaaauucuauguugcauacuuacuagcaauucauuucaugauugggaauguauucucccagccuuuagguaaaauuaauuggaaagacuuauauaauacuguauauugaagaucuucagaagaaaaccauguaccaacuagccaaaugccaaaaaucuuaagagacugagaauaucacguccuuuuagauuuccuaaccuuguaugaucguaagucacuuuagucucuuguuacacuauagauucucagggcuauucucuagcaauucuguuuguauagaccugggauauguaagaaucuauaauuuuuaaaaucaucuuagauauguugagaaacccucuugacuaaccucaaauccaauuuuuugcauuuaagaaauuuagggcaauugggaguaaaauaaagcacauuucaaugauuuuuggcaagauuaacuugcuuuugagaacuaaguaaguugauggcacgaaucuaaacagaauucauuucucuaacaucugaucuucagugaauguguuuguauguguguuuggaguauuuugguucaaacagguuuucuuuuuuaaaauauagguuaagcauggucugugucugaagugauguguuugauugacagugaagacaaguaauuaucugacauauccuggaagcauguaaugaagaaaucauaaaccuagaaacgaccccaagaguucuagucuagcaaacuacuuccuagaaggaacuacaucuaaagucucuuauagagaguauuuauuuuuaucuuaaauaucugaaggaaagacauuucuuuaacugccccuguuaaucucucccaguacuccauauggaaauauuguaauugguguaaauuuuuuaguugucacaugugucccuuuuuuucuuuuuagaaagaaaauacagcauuuuuucauuuauuugagcauuccacaaauuuauaaaacaacuaaauugaacgagauagguagguagguagguagacagaucuuuaauugucacagagagaugaauauuaacuucuuacaagugaacacaagauaaaaauuuagaguagugguucuuaccucucuuuugaaacaggaacuccuuugaaguucuaagaagagcucugccuagaaacauguaacauacguaucuaccuccagaacuugccaacacuuucaggagguucauggccccuggaagccuccuagguugauaagcacuaaucuggcaggaagaagccaucccugaaauauuggguguucaguacauuuccucauauguugaagaaggcaaauuaucaucaaagcucaaauaauaucaaacacgaauuuauuaauaauacuuuaaaaaucagaagaugaaaauuaaacuauauugccuauguaauuauacuguaaaucugugcagcauaagagugcuauauuucaccugagaauaagcauuacaugauuuuaauuuuuucuagcuuuuaacaaauaaaguugagcagugaauuuacauuuucuaauaaccuugcacagaauauucauauacaagaaaagauagugauuauccuaacugcuauaggaguuagugaugagaucagcccauagagcucagaaggcuauucuuugaggaaccccaauaccagagauuuaauaauagagacaugaauaggaaagagaugacugcauuaaaaugaaaaacuuguugaugguccaucuguggggaauaugcacauuauaucuugaguuuucugcugugucugccauuuccuucuugaaucacauuaguguuaagaccuauuucccaaacagcuccucauuuuacagagcaaccccaaugguccuugacuucauccuucacuaacaaaaucaaauucaagccaauuaccugaagggaacaaagcuuuacagguauacuuuaacuuacaaaauuaccauaauuggccaagugugguggcuuacaucuguaaucccaauacuuugggaggcugaggcaggcagauuacuugagcucaggacuucaagacaagccuagguaagauaaugagaccucgucucuauaaaaaauacaaaaauuagcuuggcauggucgcuuacaccuguacucuuagcuacucaggaggcugaggugggaggaucaccugagcccggggaggucaaggcuccaugugaucaugccauugcacuccagccugggcaacagagugagacccugucucaaaaaaaaaaaaaaaaaaaaaaaaaaaaagccauaauucugaaaaguucuaaguaaaucaauuuucuccuaaacaagguuaccucaggcauaagaaaagcauacaauuuaaaaauaucuugugacuaauaauuuuaaaaaauaaaaaccauauuucugcccaucuccccugccaucaugugguuuucucuuccacaauacugagcaacuaauuuucacacaacaccguaucuccauugauggcguggugcaggguugcacagagugacaucucuaccuuccauagcuaugccaagcugccucuccuacacugcugguuaggcauuuuccucaucgaaagcauuuuccuuaaguaugucaucucuguaaggccucuucaugcuugguaucuaggguauguuuuaggcacucuuauaaaguuuguuuguauaauacaucaaacuaaaauugcugcaaugacacaggcccaauaggaaaaaucgaugccuucccaaugucaugaugcuuaucucuuccccuauuuuacccuuuccguaggguccacagucauauauuuuucuauccccuuccaaucaaaugccauugucaugacuaaauauuuauuaauaucuaguauggauucaaagagauauaagacaugguccucgugcuuacugucuaguuaggaaguuagacuaugcaaaaaaaaugauuaauaacaauaugagguagcacagacuaagugauacaugacacuuucuaauuuaucuguucagcaaauccaaauuuccauacauuuauguugcuuaaagagaaauacaucuguaauccuugacucacugugccuuuucgcuaagcugugucuucuagcauaaugaaaaauaaugugauaauauagugacauauuacugugucuucagacuguuuccauagaggcagagcacucucauggguaccgcaauggaaugagauacagaagaccaggauucuaaucugagaaauaccucugacauuuuaugugaccucagacaagugacuuaaccucucaguuuugagcuuuuucaacuguaaaguaagcuuaauuaaacuugucaauaucauagagauguuacgaagucuagcucauuaaagcccauuaaauguuuugaagauauaaauuauuugcuuuacagucauaaacaauaagcaaaaaaaucaaaaagucucauuuuaaaaaccucauuuuuguacaauugucacaaaaaaugaugcugaugcccucuagagccuaguuguagagguggauuuacacuaauccguccaugcucucucauuugguuauuuuggugaccaauaccacuuaagacagcuggauaggaugagguauccgucugugaccacagaacaaaguaaagcuaacuggccccuguggaauuggaccaaugacguaggucucauuagcacuaucugcuaaccaacugagcuaauuggauacuauguugauaauaauguaucaaaauaugguuugguuuauuuuuuuccaaagcuuuccauauauuuaauuucuauaaccauaaaaauuaguuugaguaauuagagccaaagacaauaagcuagacauuauuagaagccauuaaccuccaagggaauaacucuugcuguccccaauaggccuguaguccucagcaggcucuugacugcccugagaaagugaaguuucagaauggcaaggcuaauaaacccaaggcccuccugaugagauuaggaacggcucuuacgcgucucuugcucacuaagagucuauuggcaagaauuagaaauuguucuagucugugaguccuguggaggcuaauaaagugacagugaagaugcauugugcuacagaaaacaguccuaaguacuaaauaaaaaaugccuuaacacugagcucauaacuuuaccucuugggauugaugauaucuuuuggcagauagcaugaagcaagccuuaaugaggaacugauauuaggcgggaccauuucaguaauucuuaguucuuugaacuuugaggcaagguuaauguacaugcuauuucacggaaccaaacaaaaauauaugauguugaaauauucccuuucuagaaauaugagaguaauagaacccugcagugcuaacaaaguagcauguaaaucuuagggcguauacuugagauuucaaguagaaugaauggccuauuuggcucaaacuagguaaaguugaauucugcaaagcuaaaauacuggaaauuagcuccaugauguauuaacccaaauaauaauguuccugacguaaaaaaagauggaaauuaaacaucuaguuaugaauacugcgucugcacaaugugcugcaugcaccgcauguguuagaauuucuucucaguuccuuuuuuaaucuuuuauucauagcauugcaggugaugaaaaauuuaugccuugagucuggcauugaaauuaaaugcaaaaugaaaacagaagcaguuuauacugacagcuuaaauaucuuuaucuagcauacgguugcacuauaaaaaucacugggugacuuuuuaaaucucccacauguaaaaaaccaagaguuguacaauaaugaauaaaguuauauaucuaagauaucaacagaaaaguuguauuuuauuagcauucuuuguuaauuucauuuugcuguauucuguuuuuguuuaaugggcacagacagaugaauacaagcuuuuaaaaauauugcacaaauuaauuguugauacuaauuccucagagugguaggaaacaauugauuuuuacagcauuuuuaauaagugugauuucccauguagguuuaugucuuaagcugaauagaaaacauuaaucuguaccgaagguaguuaugcuguaguaaagguuaauuauucaggugaaucagucuguucaucacuauaguaauaugagugaugcuugugaaggauggcaauaauuacaauaauauccacaguugcuagguauguaagcauucaagaguauuucuuuccuuagaauaguugcagguaauuuuguaacauuauuuuauuggucacaauucuauucauaaaaugagguucccuguaaaugguuccuauuuucuggaaauguugagucuuuuguccuaggcauaucuguauauccuaugcugcauuaaaaugcucauuguggcuuuugcugaugaacuaaugcuaaauuucaaauaguuaacucauaauguaaauuaauugaagaaaauaauuuccuuuuaauuuugugaacaaugcacacagguuuaaaauacacucacucacucucucucucucuauauauauauacacacccacacacauauauguacauguauauauauuuaugagaauuuuaaaaauagguauagaguuauuuagcauuuaaauaaguaaagcaugaaauuuagaacagucugcaguuacauaaagcaccaauacuaaaacaaccacuuagauuuccauauuuagaagacuucagcacacagcuuaaaauauuuuacacucagccucugauuuguagcucuuuccuggcuguuuuauguaaacauacuguguauaauuaugcagauaauuuuauacaauauuaauugugcuaagaguguagugaaaguguguuuaauucaguaauucauuuacauuuuaaugauuuuaauagcauaagauuaccaaaucaaauugaaauaucugugaccauuauacuauguugugugaagaguucaaauagucauauugcuuuauauuauacagaauauauuuaucaugucuuguuaaugacaaccaaaaggaaucuuaaaauauccauaaugaaaaaacuuuucaauucaguuuuuauuccaacauuaaauauacuuagagagugguacccaaaugcaauaacauaucagauaucagauuauaaaguauauuuaauaccuguuuucagcacaugaaaugucgaguuggccugcaucuuugaaauacaguuggugcacuguauuacauuauuucuuuuuugcaaacaaccuauacaaaaaaaaugcauuuuauuuauuccucuuuaauguaagaagaauguuucaagguguucaauaugagaagcaagugaauuacuaacuuuugcauguaaagauagcaucugaagccacucuccaaaucaacaaauuucagguuagcauuucuuucuuauuucuuucaucauguacagauuuaauaucaucaggaauaaaucuaaguuguuugcuucuuuccuccuaauuccugaagcaauguaaaagucuagagagguuugaagugacaggauuacaagcagucuuuugcauacauggccuuuagggauaagcggcuaccuugcaucuaauaaacaagaaagugaauucauugaauaaugaauuaaguggcauaaguugugauaacaaggagcaaauguaacuucagacgaauaguauuugcuuugugugggguuaucugagagggcugacguuccgccaagggagacugaaaaaaggcucauuauauuaagauguucuuuuacagaacacagucuaaaaugaucuugcaguuuuuuccccuguuugcugaacuccuuugugugcuucuaucaaaucaaccaucuccaccagggggauaacuaggauucuuucagacuguugaguguugucgaaaaugaaaauuccuggugaguuuuagaugggucacccaacaaugaaauagagaugucuaauugguucguccauauuagggucagcagcugguuauggaauaaaagguuguggugccccauugcacacuucugaaccaaauuaaauuauuaaucuacucuuuacuucaguguagcuucacggggauuccuaaccugccaugcugaauaaaacagaacgacugcuuuacauuuucauuauggagaauuauauuuuaaauugcaaacguucuucuauuuaguuugcauugcauaucucauuggauauguagaaaugucuucaacagucagugcuuauaacuuguuuuguuaauuucuaauuguagcuauaaauuaugaaaccaccaaaaaagaugauuugcaugcagugccaacucucuagccagaaccaguugagccaugaaaagcaaagucaagucuuagggggccauuaucuuugacucuuaaauucaaaagauacaauuaaauuaguauguugcaggaggcuuuguaaucuaacaugagcuuccgguuaauucaaccaagguuauuucaugauagcaauuucugccagggugucaaaguacuaguuuuugugcccuuguauaauuauuuugacuuuuuuguuauauaacuacucuaaagugaauauuaacuuuguggaagauuauagcugcauucaguuuucucauagcauguaauaaugucuuaauaauuauauucuguuuucaacaguaggcauaguugcaauaaaaacauuuaccauauuuucuuagaaauuauuuuacaaguuauuuucaaucaacauuuuaauauaugccaacuuuggacuuuuacuuuaaaauuguugaguuaugagagccauaguagaauuaaguuuaaaagcugguugaucuuuaaaauguaguaugauuucuaaagauaaaucacuuaguaaucacagccgaaugaggguuccauuucugauguauuggauuggcuaaaguuuugaacuucagucauugguucauuuguguguuggugugcauguguguauauuagcugagucuauuggaaaacauaaaaaccugaagaccagugaagacuuuuuauaaacuagaaauaucuuguaaauaaucuaguuuguucauuuauucaucaaaaacguauuuacuggacaucugcucauaccaaguacuguuuuaggaaccaucugaacaagacagagugaacaagauaaaguccuccuguuguggaauuuacauuuuaauggaggggaaauagauaacuuauauaagucuauaaauaaauuagcaaaaaaaaaaaaaaccagcagagcaaaauauuggggaaaaaagcaaaauaauaugaugucacauagagugacaaaaaaaaauaaggcuucuuuaaacagaguuguaaaggaaggccuuucugaggaagaagcauuugagcugagaccucagccaugagaagagcauuccaaacagagagaacagcagguuaucagagcccuggggugggaaugaauuuggcauaugugagaaacagaaagaagcaaaaccggcuucaugggcaugcaaccuggguguuacacaugcccucaugcuuaaagggcccccguuuagugcucugcugucacuaccaugaaauucuuacauuuuuaacaagaggccucacauuggucuugcaaauuacaugaucaguccagaaaagaaggcuaauauaucuagaauauagugggguggaaggggauuguagcaggcagcaaaauaaggccagugggugauauuucuggguauauagggcuggcacuggcaucaguauacuuugugagagauuaguugcacuuuacaauauagccauuuuugucugcuaggugggaaaauggaaaugcuguuuuuguucuauauuuacccaaauccucacauacagaagauaaauuccucaaaguuaauguuggugucuucuguguauugugugcacuucacagcaucaugugauuagauauuccacaaauaauaauugcagcuaaaaggaauuugccuucucuuuuaacccgaucgggcuuccuuaggaaaaaaaaauauaagauauuugguguucacauuuucauucuuucuuucuucccacaguuauauuauagcaccaaaucugugugaccauuuaacaauuagguuaaaucauguaaaauugccuauaugcaaccauuuguuaccuagaaaauggcaauuucaaugguucauagcaggcugaaauugcagguuuauuuaaggaaguaaaauagaaaucuuagaagcaucuuuguaaucccugcaggauuacuuaacagagaggggaaaaaacguaguucaggguuguucauuagagcaccacagugcacacugcugucagguucaugcugauggguugguuuccuuagagguaaauccacauugcagcaaggucuuucugccagucagcaacuucuccuuccucccuaacccaccucaccaauaauggggucuauggacugacauccacuuucuacuauguucuguauuacagcaagagaugaguugccaggaauuacuaugugagugacccaaggccgagcaguagcucagacuugcaacagguuacagagcuuuggucuacaggcuauuauucacugaugaccuuuccucuaggcaaaucuauuuccauuuguguugaugaccaugauaauuugccaagugauuacuaaguacaaugaauuaugggguccugugacagaaucuggccagcagagguuuaauugugucaaaucaggacacaauuucacugaucaggacaaagaggagauuuugucauuccagacagguaaugagcuggcaaauucucaaaaaaauucuucugaaugagaggcuuuuguuguuugcuucuuaauguaucuuugggaagguugcugguucuaaguaaucauugucaaguagcuucuuaucugauacucuuuugcauuuuagcaauacccuaaaaucccacucauuuaugauuauucuacuugcacauuccauuucuugcacuuuauugcuuucuuugcuuuuccuugaaucuuucacacuuugaaccacacaccuaucuauacauuuuuugaguuaguagugagaucaugaauuccauucuuaguaaccuagcaaaaaugaaaaacuccuaagaaguuuuagccuucccuugaaaacauuuuaaaauauauuuauuacccccccuuauauuuuccuaguaaaucuccauugccuucuacugaaagaugacuacacauuaucuacucaacucuacaauccuaaaguauuaauagaagaguguguuugacuuuuucccaugcuaaaaaggaccuccaaguuaaaaguaaaaaagauucaacuauuugggauauuuuaaucuguauuuucuucugaacuuuacacuagcacuggaaauauucuucgagugaaugaauggucucaaggaacuuauugucuagugauggaguuggacagacaaugacagcaaaauacgugcuggauaaagggaagugcagauauuuauaaaagcucagggcaaggacucacaaccuggucucagggagucaggaaagguuuccugacaucuuccugacaucuaagcugaaauuaaaccuauuuuaaggucugcacaugccucauuuccccugggucgauguaaauaaaauuaagaugacuuuccacagagcagcaugccaggauccuccuuccugaauucuaacaccuuucagauuuucuuucccaaagaacuugcucuguucuuugucuacaaugggcuuguuuaaacguuuuaugcucauucauuaccggucaaaaguaguauguucugugaugauuacauugggcacaaaaauccugggaaaaggugucaauaacaucauaaacuaccacauucaaagauaacuuuuagagacaaaauacacaaaguucccaaagaagcaacucucuaauagugggaauuucagcugcuauggcacgugaauggcaaggagcuucccccauauuucuuuaaguaggcagcugcauacuuugccaccauuuucuaccucaagaaugaacuuucuuauuuauucucagaauggcaaaagugaagaugaagagaaugaagaagguaaggacaauaaagagaggagagaagagaaacgaccaaauuccuuccacuuuccuuccaaacuguauaucuuucacugcuuaaaauaaaucacaucuuuguuucacaaucaaccuuaccaaaugaggcaggcugacacuguguggaaggagcauggacuuugcagucauaaaguucuggguuuggaucuuggcuuugcugcuuacuaacuguaaugacuuugggcaauuugcugaaccucucugagauucaguuucauucagauauaaaaauaucaauaccuagcacacugaacagacaagagaauuaugggacauaacucauaucugcucuauguaugcauuauagcuauggagugaucaccauaauggcaaaguucuacuagaauauucuauaaacaaaggggacaauuacuauaaaacuaaacaagguaaugcauauguaacaguuuucaccuuugagaggauuccuguggaaucuucucugcuuguucagugugugccaccccaccugacccacccacucucccaaggcacacacgcacccuaucugguuacggugugguaaauuaaagagaguggggagaaggaguggaggagaccugguucccuaucauaagcuuaucaguacuaauacucucagacaaaagcuauaucaucaacuuccuucacaacaugcuguagaaaccguugcucugggaaucccacuucuaaaacuagacacuauauacacaggacaaagagaagcucuuguucacuuugccacuuuggaaaauauuuugcuuugccucuuccugccagaagaagaaaagguagcucacuguuauuaugauaaccucauauuuuauugucucaucaaaacaauaaaauguucuugaagauuguucccagggucuguuuuuaaucuauaugggagaaaaucucauugucgaacuaagauaccauuauugugauauuauucucucaguuucucuaaggauaaggcuuuccaaauugaagacagauuauagaucuguguuaugcagaauugaggucacacuuaaacuuuuuaaagaacugaguaacuuaggaaguugcugagucaggcuguugagaaacagccuucuauuaagaguuuaaagaggaaacaguaaaguaucuccugccuccucgccgcgcacccaccaagccaaugguaagaauugugguuucucaagaccucuuuuauacucaaaggugauuccaugaggguagaacugucucuaccaucauaugucacuuuagucauauaucagucauauuaaguuuugaauuuccugucuuuguaucaugcucauagagguaaguugacccccgcaugcuaacucugacucaagagguuagauuguccucugacaagaucaaaguguugauagcuaggaacagacuugucaauaaauggccuagaacuuggucaauucagacugcuaagaaggaaauaaaaaaagaaagggagaaagggguaaagaggagagaaagcaagcaaguagguucaaacaggcugcucuuuugaaccuaggaauuagauauuuuauugugauuucucuacucagaaauucugcuuauaagcaggcuucaguuuuaaaccauucaucucucauuucucaaccaaagucuggauauacacaaccagaacaacuguuugcugagggauuuauuaaaaauuuggagguaaauucuguuaugagacucacuuuggcaugauaauugagacugcuguagagggaaguuucaugagcugucuugugaaacacugccucacuaucuugaaauacauaucuagaauucaaauauuggaagguaagccaugggcaugguagcuccacucccuugcauuuuaucuuuaaccaagggacguuuuagccuuuggccuccaauuuccuuaaaugugaagaagauaagauaccaguauuucauguaaaagauaauuuucaauaccuaucaacuuugaacaacuaguaaguuuuagauucuggauuugcuagguugcauagcaaagcacuuaguuguguuuacaaauacuaagauucaguauauacuuuacucagacaauuauuugaagaggaauguuaaauggaagcauauguaccccauguaaauguaaaacuauagaguaaucauaauugugucaauggauaccauauagaauauggauaaacuguugauguuauuaauaugauuucauauuaauuggagggguaagguaccuaaagguuacucccuacuauucgucaaguacuuuauguuauuuaucucacaugauccacaugucugcucugugagcuagguauugauauuuuuauaccugaacaaaacucagaaaagugacuugccaaaggucacaguaagugacaaaaccaagauucauguaauccaagcuaugugggaggcugagaugggaggauugcuugagacaaggaguucaggaccagccugggcaacauacugagaccuugucuccaagaaaaaaauuuuuuuaaguuagccaggcaugguggugcacaccuguagucccagcuagccagaaagcugaggugagagaaucacuugagcccaggaguucaaggcuacagugagcuaugaucauggcacuguacuccagucuggaugacagagcaagacccuguucccuccccacaaaaaaccaagauucaaacccaaaacuugaaugcuuccaaguccaugauuuucucacacaacauaauucugcuucaaucagguaaagcugucuguagaauaaagauaugguuuauucuaagagguaguagaaauauaguuuacgaagaaggaaaauucuucccggugcacaaacacagacuuggcaaauagcaacggccuaucucaugcugcaagaccuucuucauaugguuagguuaaagacaaucaagcccagaagccuggcuggaaccagaaccccgugcuaauaccuggaagacaaguggcauggucaccaugacaggccaggaaaauuauccagagagcuuuguggauuccugaaaaaagagagguaggaagcagaaagauagugaaauaucucuggagagccaaaucaaacacagagaaaacacugcaagacgauuuauaauuaagagcucaauuuugugguaaaaacugcuaaaugcuucaggcauuuagaugauaaaucuuugagggcuagcuuagucagaaagccugcgguagggacaagcuucuuaaacucacaaagauggauguaaacagggaggauguuccuagauguguggggcagggaagggagggaugaguaugagggaagacacaaggccagaaaaugaguguaaccucuucgaaacacucuaagauuuuauggaccuaggagaugugacaguaauucagggaauugugcauucauuuaacuaguccuuuuucaccacauaaaauuagaucaaggaacauuuuggaacccuucuaguguaaugacagcuacacuuauggaggucuugcuaugggccaggcacucugcuaagcauuuuacuuucaguuaaucuuaacaacuaccuauaagguauagaaacuuucaacugccuuacuucccacuuaaacaaagcuagcaaaugguaaaggccaggauaugaagccaaacagcauggcuccagacuguucagcccaggauguuauacccugcaaggccugccauucaggaucauaaguauaguuuuaagccccuuuaccaaaggcaauuacaguuguuaccucucaacccacaaagguuaaaacauauguuuccaaguccuacugugugcauuaauauaacaagcaagaauuugaugaacauucacugugcgccaggcauuguucuaaguguuuuacaugcauuagcugauuuaacacucacaacccauggggugauaauaucucaggucuuagaggagaaacugaggcuuccguuguuucuauaacuugcccacaaucacacagcuaguaagugucagagacaggauuucuaccaaguuaguuaugacaaaggaaacagaaaaaugcucaacagacuugaagaacuaaaaaauuccauauaagugagacaauaagaaaaauguacaaggggccaagcagguggcucacaccuguaaucccagcacuuugagaggccaaggcaggugaaucacuugaggucaggaguuugagaccagacaacauagcaaaaccuaaucucuacuaaaaauacaaaaauuagccaggugugguggcaggcaccuguaaucccagcuacuuggguggcugaggcagaagaaucacuugaacccuggaggcagagguugcagugagccgagauggcagcacugcacuccagccugggcaacagagcaagaagaaaaaggaaaaagcaaaaggaaaggaaaggaagaaggaaggaaggaagaaaggaaagaaggaaagaaaaaaaggaaggaaggaagguaggaaggaaggaaagaaaaauauacaaggagaugucauuugaacugauauuuaauggguaggauagguggaaggcauuucagaaugagggcugaggucuggggugggaagaguguuagaaggacuagaagcagagagaccacucacguuaggugcucaaagaauuguugaauaagugagcuggugcaugcaugaauauccaaaugaaucagcggggaaugaaagcaugcugauagugguaauggaaaggagaauaacagaagagauauuauagaggcagacugcaggauuuaguaacuaauugggauuuuggaaaaagggaaccagagaaagagaauguuuagauggggacaaguugaaucugaaauggcaaccguauacuuugaaauguuccucaagagugggaaacaacaucuggaauuuggaagcaaguucauuauacauaccugucaaucaacuuaguuucuaguguagcaaagaauuaauucuagaaaaaaauuaaaacuuugaaaacacuuuuaggccaugcaaaauuuuguagaaugcucucuuuccauauaaaugaguuauuugcuuuaaaaaggaagaaugagagagagauaaaguaaaacaaucuacugguaauaaaaacacugccuuauuucaagcagugcuucuaugaaguaaccuugggauuauauacaaagcaaaugaaaaguaaauugugacugggccaauuaguacauuucuuuuuaauguugaaguucugggaaccugauuuacauugaggagaaauuugagauaauguucugggaaugugagauggaaauuuccagucugucuaagucuuuuaagaggauagcagaaguuguaccuagaauucaaguuuuaguacgaccucuuugaaacuccccaaauguaggaaggguauuuuauuuuuaaaugcuuaaaauucuuuacacaaucuacuggaaaaagaaaaaagaugaugauucauucuaaaguaaucuguucauucaucaucaagugaauggaaccauuuuccagcagguagcuguccuuaaauuacucaccaccccgcaguaaguacaaugucugcaauuguuaggacacgaaaugucugggaaaauaagaacaagagggaacuuuuggcaaagugaagcuaucagaugauacagauugggaggcuuugauccugucgugaugugaaggcuucagauguuaaugaugacuauguaaaacaguccaguauggaagcaucuaagaugaaauucuuguaaauuuuuggccaggaaccuaaaacuugcuucagucuguggcugaaauuuuugugccaaaucagaaggcacuuugcugguucuuuuuuuauagaagggccaaaugagauagauuggaaauauguacuuugaacagccaggcagagucucaggaagucugccaaacaagauuuccaaauaaaauguuugggaaagaaaacagggauggacuuugcagaugcuggauggauuccaccagccaucugugcaaagaguuacuuggugucacaucagcugagagcuaugaaguggcacaaaacuaucagcaauaacuucauuguuaaauggauucauuuauuuaccaggcaaccuuuuauuuaccgagauaaaguaucugaauguaucugccuuuccugugagaaacaauagcaaugaccaaaauuauugaaacauaaaggaauuucggcaauggaacuauuaccucagugcuaaugcauuagcaguugaagaaggcagauuaauuuacuuacggugagcuaagugcauucuuggcucacgaagggaaucauuugcucacuuaagccagagaucccauuuuugacggcaaaugucacugccuggauuucccuuugacagucuggcaaccccacaccccuguuauaguauccauuuauuugucuuauuuucagccagauuaauccauucuguuuugacaagaagacugauggguaauugauaacugugauagacacaaacagaagaguuggaugcugaauaauucagcacuuuucaguaucaauaagagaacagguugaagaauuugugucucuauuuacacuuaaacuaaacuaagucagcccagacauuuaugcugccagucuaucagaaaaccaaacaguguacauucgguuuccacccgacaaaauguuuuauaagcuuguaacaauaugugugaagcugccagaauaauaaauagguacagcagcccaugcaugcuaauguuauguuguaagcaguuuuguugacaagugcuaauacuucuuucauacuaucaucaaaagcagcuaauacaacagccauuauuugcuggcuuuccaagcaagacaugauggauugugaccuuaauauggguuagccgaguuuugaaaguuaaacaacuugcaauaaaucauagaauuauuacaaugcaguuuaauugguuaaggacuguuuauuuccuaaacagggugaaaaauuucuguuucggcacuuuuaauuugcaaagugcauuuucauuaugaauggcaguuuaauauucugcucuuuugucaugcaaaauaugcaacacacaggcaaucuauuaauuggacaaaaaugcauugcaagcguaaauuauccuuuauaucaucacuugugagcuuuuacaucuauuaaauguguuaaauggaacauaguuaaagacuguacaacuauuugcaggcuacuucugaaauuuaagucaagcuucaagaugauuuuaaugaccuuuauuuuuggcaaaauaaaguaauuaaguaauuguaaauaaaaagggcaguuuaaagaguuacuccuuccuuaaggcauaggugcauauguuuuguugauucagcaguugcaggaaacagacaauagcacuguuucauauugauaugccuugagaaauggaaucaaaccucauguauuuacuuuucucuuugccaugguauaauuucuagagcagaaauuuccauuggcaaacguguagaaauaggugaguaaggcaguagcaaaaugauauugcagcauagcucagcauaacugaauagcugccuccauaugcuuugguucaaugaugugccuuuacacagggcuauuuagagugcagaaacaguaacaaaauacuuuguacuaggaauguugauaugacauauguuugauuuucagaaugccagaucucucaauguguuccuguaagacugccuuaaaauacauacaaccuauucauuuacacagaacucugagaccguuucucauauuuauugacaccuguguagaccuuuugaaaacuuagaaauuccacugauuucaaacauuuucuauagauuggccccgaugaagcgggguuacuauagugcugucacuccaagucuccuucaaagauacaaauugucaguauuacaaaaugaaaguuagaaguauacuucagacaggcauuccauucauuuuuccuagguuauaaaaguguuaauaugagagugcauucuguuguuuuaacagaaaaacuaaagaacaacuuuuacauacacaaaaggaauacauuaaaauaaacuguucagaacuuagaugacaaagguagaaaccaaaaguucugcaaauugaagaaauuguucaacuuucuuuauguuauauaguggcacaaaugugccacaguuucuuagauauuucauucuaaaagaagauaaaucuaguuauagaauuuuaaucuugcacuaacguugaucauauucccucccauuuaaaugucaugcuuaccuaagcuauguaauuucucugccucaggaaaaaagaaagaaaugggggaagacaaacaugggaaugcaggcagagagagagagagagggagggacuguugauauauuguguugauuguacuuuuuggcuucgcucguggugaaaugcuaagguaagaauguacuauucaauaaguaauauggauuguuaaaaaucaauuaucauuaaccaucacaaaugacuaaaauuuuucaguauagauuagaaaguuuugucagggacauagccaugauuagaaaaacauaagugaacauaaccaaaacucuuaacuuaugaaggcaauaaguugaauugauuacaauacuuccuugggcacuuuucaaagucauaaguuaacagacuauaucuuggauuuauauaagaaucacaagauuuucugaaagcucagauguauaaaacugagagcacauuggcuauaaacugaaucauuuuguuaauauaaauuuucaguuaucacuuucaacugacuuuuccucauauuauaaaaaauucaaaccuauagaaaaguugaaauaacuuugcagugaauaccugaacacccaugaucuugagcuaccauuuugcuacacuugccuuuucauauaccugcccaucuugccacccauccaucaauccauauaauuuuuugaugcauuucaaagucaguuacagccaucguuauauuuuuccagaaauccuucagugugcuuaucauuaacuagagugcaaaauuaauuuacaguucuuuuuuucuucugagaaaucugcaugucaugaaauguacaaaucuuaagugugccauuugaugaauuucagcaaacuuuucaugaguuucagacacguaaugagcucuguuagauauugauauuaaaugaaauccagugaauacagaagacucaaaagcucuauuuucaaacuguucaccacuguuagacugagcuaaucuacagggccaccuccuacuuaggacauucacuuuugcaggucucuaguuuauucuguuuugcuaggaagaauaguuuauaucauugggcuucaucaacaauuauaauacuacuuguuguguaccuauuacgggcaaagcauuucacugagugcugugaagagcauaaggagccuuaagauauagaguccaagauauggaguccaucaaagagccugugguaaaaaauguauacuaccaacuaaagugggauaauacaagauuauauacuuagaaaccaagcgaguaagagagaaaaugccagggguguuuagaggaaagugguaagaauaucuuggcguuugacgggagggcucccucaacuucaucuuucgcuuuuaccuugcuggcuugcuuucuuuuccucaaacacacugagcuugcacccucauugcagccuuuguaguuguucccccuuugccugcuuugcaacguaugacaucccaagagucucagaugauguagaugacaucuacauuaagcaguguuucuuuucaucuuacucuauuuuuaugacacaacauuuucucuuuaguguguccaucacaugaggaacacaaaaauccugcaagauuuuucaguguagcucaguuuaugaaaguauaccuacggauuguaagccuugaauaguuuuguauaguuuaacuugguauggcuuuugcauauauuauauaauuuuaugcucacaauaaucugugagaucugcaucgccuauacauauagagaacuuacacacacagacacagacacacacacacacacacacacacacacauauagccuauuuaggcauacuucagagauauugucaguuuggucccagagcaccacaauaaagugaauauuucaauaaacugagucacacaaaguuuuuccagugcacauaacacuuacguuuacacuauacuguagucuauuaagugugcaauagcauuaugucuaaaaaacaauguacauacuuaauuuaaaaauaauucauugcuuuaaaauacuaaggagcaucugggccuucagcaagacauaauaauuuugcugguguagagucuugucucgaaguugacagcugcuaacuagucagaguggugguugcugaagguuggggugacuguggcaauuucuuaaauaagagaacaaugaaguuugucacaucaaaugacuuccuuuuauaaaauacuucucuguagaaugcgaugcuguuugacagcauuuuacccacaguagaacuucuuucaaaauugaacuuaauccucucaaacccugccacugccuucucaacuaaauuuaugaaauauucuaaauucuuuguugucuuuuuaaguguuuaaagcaccuucaccaagaguagauuucauaucaagaaaccacuuucugugcucauucauaagaaucaacuccucaucuuuucaagcuuuaucaugagauugcagcaauucacucacaccuucaggcucugcuuuuaauucaaguucuccugcuguuuccaucacuucugcaguuacuuccuccacugaaguccuaaacaucucaaagaguuggaaucaacuucuuccaaacuccuguucauuguugauauuuugaccuccucccacaagucacaaauguucuuauuggcaucuacauugaugaauccuuuccagguggauuucaagugacuuuucccagguccaucagaggaaucacuaucuuuggcagcuguagucuuacaaaauguauuucuuaaauaaugagacuuaaaaguugaaacuacuccuuguuccaugggcuacagaauggaugugguguuagcggcauaaaaacaacaugaaucuccuuguacaucuccauuagagcucuuggaugaccaggugcauuguuucaaggagcaguaaguuugaaaauaaucuuuuuuucugagcaguaggucucaacaguggauuuaaaauauucaguaaaccaugcaauaaacugauaucccaugauucaagcuuuauuauuccauuuauagagcacaagcacaggagauuuagcauaauuccuaagggcccuaggauuuuuggaaugguaaaugaacauauaggcuucaacuuaaacucaccagcugcauuagccuuaaaaaaagaagcaaccuguccuuugaagcuuuggagcaagacauugaccucaccucucuaacuauggauguccuaaauggcgucuucuuccaauagaaggcuguuucaucuacuuugaaaauuuguuguuuaguguagccaccuucuucagugaucuuagcuugauccuuugaauaacucgcugcagcuucuccaucagcacuuccugcuucaccuugcacuuuuaugcuauagaaacagcuucuuuccuuaaaccucaugaaccaaguucugcuaccuucagacuuuucuuuugacacuuccucaccucucucagccuucacugaaucgaagacagggucuuacucuggauuaagauuugguuuaagggaauguugguggugguuugaucuucuaccugacuguaaaaccuuuuccauaucagcaauaagguuguuucacuuucuuaucauucauguguucauuggaguagcacuuuuaauuuccuuuaaaaauguuucguuugcauucacaaccuggcugccugccuggugcaagaggccuggcuuuuggccugucuuggcuuuugauaugcucccucacuaagcuuaaucauuucuagcuuuugauuuaaaguuagagaugugcagcucuuccuuuacuuguacacuuaggcacaauuguaagguuauuaaugggccuauuucaauuuuuuuuuuuuuugccugaggaaagagggaggcccaaggagagggagagagacaggggaacaguugauugguggagcagucagaaaacacauaacauuuaucaaauaaguucaccaucuucugugggcgcaguugaugccccugcaaaacaauuacaauagugacauugauauaguuuggauauuugucccaacccagaucucaugucgaauuguaauccccaauguuggaggugaggcuggugggagguguuuggaucauggggguggaucccucaugaauuccuugggccaucccauuggugauaagugagcucucauucugaguucacacaagaucuggucauuuaaguguaugacaucucucccucaccucacuccugccuuuuucaugugaugugccuguuuccccuuugcuucugcuaugauugacagcuccaugaggcuucaccagaagccaagcagaugccagcaucaugcauccuguaaagccugcagcaccaugagccaauuaaaccacuuuucuuuauaaauuauccagucugaggaauuuuuuuauggcaauggaagaauggcccaauacaaacaccaaagaccacugaucauagaucacuuuaauacauauuuuuuuuuuauuuuuuuauuuuuauuuuuauuuuuauuuuuuuuugagacggagucucgcucuguugcccaggcuggagugcaguggcgcgaucucggcucacugcaagcuccgccucccggguucacgccauucuccugccucagccucccgcguagcugggacuacaggugcccgccaccacgcccggcuaauuuuuuguauuuuuuuuuuaguagagacgggguuucacuguguuagccaggauggucucgaucuccugaccucgugauccacccgccucggccucccaaagugcugggauuacaggcgugagccaccgcgcccggcccacuuuaauacauauuaugauaauaaugaaaaaguuuugaauaucgccgauuaccaacaugugguacagagacaugaaaugagcacaugcuguuggaaaaauggugucaauaaaauugcuugaugcaagguugccacaaaccuucaagucauuagauaaaaacaaaaaugcaauaucuguggagcacaauaaagcaaagcacaauaaaacagguaagccuuuauguauauagagaguacuuggagaaauaaaaucacugagccauaaguuacaaauaaacugaaacucaggaauuuuauuucuccaaguuaucagcagaacuuaauaaauaccagcuaucacuuuuguuucuggagggcugagacaaagcacuauucacuguagcaacuuguugaaauccucauauuccuuugccuccucuucaccaugcaaccccugcugcaaccacuccucccacaauucauucaguauuucaucagccuuguaacuaucaugacaacuuauauucagucuuggggaaagguaagauacaggcuuucaaaaaaauagguauuucaaaaauguuaccagcaugcuaccaucuucauaaaaauuaaggauccuugaagugucaaguugacuaaugcacaaacacaaacaagaaaugagagauaaauuuaaguaucuauuauuuucauaggaaugaccuacuccuuugaaaaggccauuuuaaucccaaauuucuauuacuguuuaucaaccaaaaacauuguucaguaaugccucaucacuauagaagaguugucccgaugcuucucuuuaggaaucaugucaauuugaguuauaguacaugcuaguuagauacaguugcugaagacauugaaucuuuucaaagauguccuuaaaugcuaugcaagagaguaauuauaacaugcuaauuuguagauucucuauuuuuauguuccuuguuuugccucuuuuugccucuggccuucggcagaauucugucacuuaucaaaaucacuucuguguccaaaaucccauucuucaguacuaaaaaauguauaauuuuaaaaauuaaaacaauauaauuuccugugcaguauuuuaguccaugcaaacuuuaauuacucccuguuaauauuuuuuaaaauauucuauuacuccuugaucccuaacuuuuauacaggaaggcaaaugaauuuauuaagauaagggaaaaaaucuuguacuuuuugugaguuaugcaagaaucuuaugucuagagagcaagaaauauaucuguaugaauuuuuuucauuccaacuauggaaucuuucuugcaacuuuuuaguaaauuauaauuccauuacuuuuuauuccccaaggaugaaaaaaaugagcuucauuuuuuggcaaaacaaauaaacauccugaguugauaaaaauaucaauuacaaaagugucuacccuaaaagucacauucauuuuguuuguuauugcaaguuauuaaaaggcuuccaggcaugcauauaaaaccugaaaaacaacaguugaaucuaucauauuaaauuaaaaucccuccauaaaaaaaguaaacccaaguaguuuaucaguuagggaaugccaugcugccccagaagucaauacaaauaagacuuuauuaaaacauaacuaaaaugaaguuccacaagaauucuccaugggaauuguucugccucaaauucaaacguggagaguaaaaauacaucagcugaccuuaauuccuuuaaaguaacaaaggaagaaaacggaaacaaauuccaaggccaacaacugaaauaacacuucagaaaauauagccucacaaagguauauauggaaaaauaacugcucugcaaguuagacaauucucugcuuucaaacaauuuaugcucuuuaauauuuguacuagugguaagcuucuuugaccauuugucugauaccuaauguaccuucuuaaaugaaugccuacaauucuguguagcugccaugaguuggcaauccagcucauuuucuucugucuuuaguuauucuguauuacuugccauaucauuaaacauuauuuucauaagaguucucuauuuucuuccccaaagcaacauauaaaaaauucaaagggugugcucagauuuggacaaucggguuguaguacagauacgauaggcuuccaguuauacacaguucccaacauguuaguuauaucucuaaccagauacacaaguguuaacacaucccaucagaaagcugauguucuacauuaucauguuaaauguccacaaauuauuucauggaauggaugucccaaaauauauuauuugaauuaucuauaacuggacauuuacucagucucuaauauuuugucuaaauaaugucaugauaaacauuacuuagcucuuugaacauccauccagauacguaaugauuagaaucuuaauaucuucaauauuuaaaccaaaaauacaaaccaaagaucagcaacaauuuucauaguuacauaagaaagcaauuuuccagauagcuagauaaagaaauuuuccauuauuaccuucaggcuuucuuauguaccuagugaacuuacuucuuuauguacuuagugaacuacagaaagcaaaguaauguaaauguguuuuuuuaacuguuugauucacguuugaaagaaacuacccuucuaauaaacagggugcaguauuucagacuaucucccaaauauggaagauaucgaauaucuucuucaaacacaaaaagguuauuauguauuaauggugacagguguuuggguacauaucaguuuacugcccacauaaacuuauucugauauuuaccugagaaaugagcccauauggaacaacuucauucaacaccaagauguaccuugaugcccuguugagacacauagaacacugauuaauguuaugaccuuuuuacaguucccccuuuuaaagaaauaaaaauuaugcagucuuuccucauagcuucaguuacuacaacauccugaacggaaaaauuucagaauuuuucaugggaaaacuuucuauuggguaaacauauguguucuuuccuagcuuuauuucuagagggaaacugucaagguuuuucauuggcccaucuucuaucucauuaucccuaucuucugaacaccuguggcuucauggcaucaauaucuauuuggaggcuacaacaauugaaacuaaucuaaacuaaucccagaaagaguaaaacaguaauauuuuauguugcauguaacagugaaaauauugggaaggacgugaggaagaucugauguguaugaguggcacaguaccuagcucuguccaugcuuccuaaauguuucacugagcucaguagguuuacauggcuuuaaaagaaacuaaggagcccauacauaccuuugccuuuauuuaaauaaucuuuaaaguucauugagaacuguuuguuaaauauggcagacuguuagauauggaagaaucuucugagaccucacaaaaauaacagaaaugguauuuuuugaaaguauaaacccaugaagacaaaaugaauggcagagaagacaacaauguugagagauaucaggaauuugaaaaacauaaaacaagugcaagaguggagguuauaaccuaaguaucuggaaaagagaaucuuacaaaguagggggauucgcccaacagaauuccagaaagacuccagauucagaagcacugguuaucuuggaaggcagaauaguagaaaguuggaaguuucugaguccacaauuuccuccuccauaggauauagaagacuuauuucuaaaacuaauuccauuaggaacacucuagguugagggugauuaauggaacugaaaacacgagaagaaaugaauaucugcccccuuguccuuagaaugguuaccugccaguaauuuaccuuccaagugggagauucuuuucuggagaaaccaaacagcccuagagacaagagccucaaauacuaaaauuuggaaguccucaaacaaaaauuccagcuccagugaaaccccucaauugacagccccaccuccuucaugcuuacccacgaacacauaucuuccaaagaguucuuuagggauuuggauuuaaauaugauagccuagaauuaccuagauagccuaaaugcuugaggcaaaucucuaacaugaauaaaagaaaucaaaagagagaaauagaaaaaaaagaacccauaggaauuagagauacaguaucacuaaugaucuagagaucuaaugaucugaucugaagacacaccugcauuagauggcagaagaaaacugaagaaaaucuacaauaaauauucucagagaauuaagaauagcuauuggauucuuauaacaagaacaaggcacuaauaaaaaaugaccuauaagaaaacaagaaauuaaaauauucuauagcaguuugaaagauaauguugagaaauucugcuagaaaauaaggcaaaaagaaaaaauguagaaaauacaggaaacgauaacaauucgagaugucuuccuaacgcccaaauaauaggagucccuccuucaaaaaaaaagagaacagaaaauauugucagaaagaagauuaccaaacaucuaauaccaaaaaaaaaaaaaaaauucaauauggaccaguuccauauuaaaaggauuuaccaaguucuuuguacaauacaugaaaagagacccauaccaauguacaucaucacgaacauuauaacucucuggggauaaagagaagaucuuaaaauccacaagagaagaagaagcaggcuaaauagagagcacugggaaucagaauaccauugcucaccucaaaagcaacacugaaaaccaaagacuugcuuucaaaauucagacagcaugauagagacauuuucacacauacaaggauucaaaauauuuaccucuuaugaacagguuuuaaaagaaaguacuagaauauugcauuggcaaaauaauggagcaaaccaagaaagaguuagauucagaaagcaggaaaucuaacacaggagggaagcaaagaaaagucccagcaugaugacugugcuguaggucuagacagucuggauuaaagguuacaggaaaucuccaagucccaaaagaccagagcugugaauggguuauaaauguggggaaacugguucucucauccuuggaguggcuggguggggccuggaauggucagagucccaggccaguggccucaagccuuuaauacucuccucccauuucucacaaagaaccauaaaaauauuauuuucaaucugugccaugacacagaacauguugaaaagcauucugauauauuuguugauguacugaaacacucagaaaauaugauaggcuuuuaauggaucuacugagagcauuugaaaaacucauggaugguuacuguggcagacaguggacugauaccuaaaagccauucacaauccucuuuuccuuugaguucuuuggcguagggacuggaaaccugaauugcugauuuuuccaaacuccauugugucuagauguggucaugugacuuaguucuggccagugagauguggguagaaccugcugagcagagcuucuggaaaagcagcuaaucaugaccauggagcuaagacccauacacuaagaauggaggaacaggaggugggaggaagccugaguccuugguaauacugaggugucuuccccucaugguuguaaguggcuacacuauggcaaauaaucaauaucuaaaauugaugagucaagagacagaaauauuagaagacuauuuagaaaaauggagguaaauaucagaagaaacagaucuuucugcauacuuguugccguugagguguggggaagggugagaaaaugacauauuuuccauuauguauuauuuaggcuuuuaaagcuauguguauguauuauucuaauaaaacuuaauucaaaguacucuaaguuaccaaaaaagcaagagaugauagcauugaaaugaaauccugaugucaaagucucaaaaauagccaguagaauuuacauauuccucaaaucagaaaagaauaaagguuuauuucauggauggacuaagacacauuuaacuagauccuuuuuuucuucuaguuucucucacaguuacugugaaaaucuaaauguugaaaaacuuaaaauuuuuuuuuauuauuauacauuaaguucuaggguacaugugcacaacaugcagguuuguuacacagguauacaugugccauguugguuugcugcacccaucacuuacaguaggcauuucuccuaauguuaucccucucccagcccucaacccccgagacaggucacagugugugauguuccccgcccuguguccauguguucucauuguucaacucccaccuaugagugagaacaugcaguguuugguuuucuguccuugugacaguuugcagagaaugaugguuuccagcuucauccaugucccugcaaaggacaugaacucaucuuuuuuauggcugcguaguaucccaugguguauuugcgccauauuuucuuuuuuuuuuaauuuuccugacuguacauuuucuuuuuuauuuuauuuuauuauuauuauccuuuaaguuuuaggguacaugugcacaaugugcagguuaguuacauauguauacaugugccaugcuggugugcugcacccauuaacucgucauuuagcauuaaguauaucuccuaaagcuaucccuccccacuucccccaccccacaacaguccccagagugugauauuccccuuccuguguccauguguucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaauauuccaugguguauaugugccacauuuucuugauccagucuaucauuguuggacauuuggguugguuccaaaucuuugcuauugugaauagugcagcaauaaacauacgugugcaugugucuuuauagcagcaugauuuauaguccuuuggguauauacccaguaaugggauggcugggucaaaugguauuucuaguucuggaucccugaggaaucgccacacugacuuccacaaggguugaacuaguuuacagucccaccaacaauguaaaaguguuccuauuccuccaccuccucuccagcaccuguuguuuccugacuuuuuaaugauugccauucuaacuggcgugagaugguaucucauugugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuauguuccguauuuucuuaauccacucuaucauugauggacauuuggguugguuccaagucuuugauauugugaauagucccacaauaaacauauuugugcauaugucuuuauagcagcaugauuuauaauccuauggguauauacucaguuuaugggauugcugggucaaaugguauuucuaguuucagauccuugaggaaucaccacacugucuuccacaaugguugaacuaauuuacacucccaccaacaguguaaaaguguuccuauuccuccacauccucuccagcaccuguuguuuccugacuuuuuagugauagccauucuaacuggcaugagaugguaucucauugugguuuugauuugcauuucucugaugaccagugaugaugagcauuuuuucauaugucuguuggcugcauaaaugucuucuuuugagaagugucuguucauauccuuuacccacuuuuugauggggcuguuuuguuuuguucuuguaaauuuguuuaaguucuuuguagauucuggauauuagcccuuugucagauggguagauggcaaaacuuuucucccauucuguagguugccuguucacucugaugauaguuucuuuugcugugcagaagcucuuuaguuuaauuagaucccauuugucaguuuuggcuuuuguugccauugcuuuugguguuuuagucaugaagucuuugcccugccuauguccugaaugguauugccuaggauuucuucuaggguuuuuaugguuuuaggucuuacauuuaagucuuuaauccaucuugaguuaaguuuuguauaagguguaaggaagggauuuuaaaaccaauuuuuguuagaaauguugagcuguauucccacugggagaaugucuuaguuaguucaggcagcuacaacaaauuaccauaguuggguggcuuaaacaauaaacagcuauucucacagcucaggaggcuggcaaguccaagaucaaggugucagcagaucaagugccugcuaagagccaacuuccuggauugcagauggcuggcaucucuuuguauccuuauauaguagaaagcagagcagagacagcaaacucaucuuucuucuuauuagggcacuaauccccuucaugagggcuccaacuuuaugaauaauuaauuccaaaaggccccaccuccuaaccauuacguuggcguuaggacuucagcauaugaauuuugcagugacacaaacauuuaguccauaacagggggaaaagcaaauaaacuaaguugaaaaguccuggucaaaccagaaguaguuuauuuuagcaauaauuucaauauuuccaagaguuauaaucuucuccuuugucuucucaaucuagaaguagaugucauuucuaauuuaauaauucuuuuuuuacucuuaaauuuaugcuucgauaacuuuauucuccucuguucauuuuaauguaauggaacuccuugugucacacacaguuggcauuucaacuuacuucauuuuaggagauuauauaacuuaaggucuugcacacugaagguacucaauaaacguauguagaaaauuuggcuaugcagagcagauucauauugaggcuauuacuuaagacaaauuuaggcacaggagcaccucagccucuuaggagggacaguuuggucucuuaugacaaucagaauagaacaaaguggagagauaagugaggucagaauggggaaaguggcaggaugcaggcaaacauguucuuaauuuagagacagaugaaggcucaggacuuuccuaggcagauaaaagaagaaagaagcugcuuuuugaaaagagggaucaagauuaggacaaaaagggagauucagccaucagcagaacccaaaugagagccuacaaagagacacugucuacucagaguacaucuucagacauccagggucccaagcuacuguguuuacuguuagcccuuagccauuguuaagucuuacugcuuuauaacucuucuuuaagaauauauuaauaguaaaauuacuuacuccuauauauacaacgaauccuuaauuaucaaaaacauuuauagucaucaccucaugauucaguuugcccuucucuaguccaaaugaauugaaguaggaauucauaggaccguuccuagugaagaaagauuuuagugcuauuuaaagaaaguaaaaaguauauucuccucugauagaaauuuucauucugauaauauuuuauuuguaucuuuuuuuaaugucauggcaagaaaugcaguugaugggcaagggacaauggcucacaccuguaaucccagcacuuugggaggccgagaugggcugaucaccugaggucaggaguucgagaccagccuggcugacauggcgaaaccagucuuuauuaaaaauauaaaaauuagcugggcaugguggugggcggcuguaaucccagcuacucaggaggcugaagcaggagaauaaucacuucaaccccagagguggagguuguagugagccgagauugugccacugcacucuagccugggugacagagcgagacucuuucucaaaaaaaaaaaaaaaaaaaaaaaaaaaaagaaaagaaaaagaaagagaaaagaaaagaaaaagaaauggaguugauuuugaagagaaaucauuuugaauaauuaaccaugaauuacucuaauuagcagaaaauaauuauagguuggacauacgcucuuucaaaugcagaggauagaguaaaagaauauuggaaaaauaaugccaccuuauagauguugcgaugaaucccaaagagggcuuuucuuugaauuaaucuuuaacuaaggcauguuaaaugucuuccauuagaaaacauucauauuucuacaagacaaaaauuauuaccuagcauauguuguuaguuagagaaucuuuauuguaauaauuauuaaagaagacaucuuuaaugcuuccuaaaagagaaaauaucauuuccuuuguuccuuuuauaacaccuucuggaucaccagaacagccuucgauagauuuagcauauuuguacaucauaggaauacuuaaaacacuguuuguaaguggaguuuaauauauucaugucacuuggaaaacguuugucaagugauuaacaucacaguugcacuuguggcuucuguuuccuguaggggaagaauauguggcacacugaugagaacagguaacagauuccuuugcaauuaguuucuguucugcaaagaccaucaucaggacugaaaugagagcugacaaaaagguauauagucuacgugagguauacuuuugggcuaaagggagcccagauaugggacccaggagacaugugcucagauauggcaccacagauaacuaguuagucccugacuaacuaugcaacuuggauaagucucauugugccucuuuagcuguuucuuuauuaguaguaccauccaucucacaggauuguaacaugguaaaaaugaaaugugaaauuaacuuucgaaaguuaaaagcaacagcaacaacaaaaagguaaagcauuguuuggacaaaaauguaauuuuuuggaagagguaguuggggaggcaauguggagauguagguccaaggauaaaaaguuguaauuauguaggaugaacaagucuagaucuaaguacagcaugaggacuacaguuaauauuguauuguauuugggauuuuuugcuaagaaaguagaauuuagaugcucuugccacacauacaaaaggguaacugugcaaguugauggauauguuaauuugcuuaacauaguaaucacaauguauaucacagcaucauauuguauaucuuaaauauauacaauaaaaauguagcuuuaauauauaugauuuuuaccaaaaaauaauuugcaauuuagaaaugaggaguaucuggcauauggucgaauaaagcauaacuuauuuucauauaccaucauauauaaaaauaaauucaaagaugccugcuuuuaugauuguuaagagcuaauuaugcaagagaguaucuuugcaaagaaauauauagugacauucugaucauuggucacaaaugugauuuucuagguuagguuucaauuuugaaaacaacauucuugcuucuuaaauccuugcucuuuuucuacaucacucuuuugccaccaucaagaaagcuuuuucuauaucacucuucugccaccaucaagaaaacuguuuuucuugauuguucaaaauaauaaauggagucaaagccuauguguagaauaaacaaauggucucacuugcuuaaaaaauaacagcacuccuugauccuuucauuauaccauccucucuccucuucuuuucuuuucuccuuaccugaaauauugaaugaaacauuaucuccagugaaucgcaauuaaaauauauguugguugccugggagaggagagaaaggcccaagaaucuccuuuaaucuucucuuacaggcuauuggcauggauucuuuuaucugauuagauaaaacaguuagcuuucaguaugggcaaguuggacuaggauuucaggagaagcuguuuagugguuauaaucggugauuuuuaagguuccuuucaacucugaaauauuuuauuacaaguagaccuguguagccaaggggugcccugagagauaaagggagggagacuacuaaaugacagugaagaaguaagaucauagaggaaaauuaugcacuucacuguuuugccuggaacuagacgggcaaaggcgugggugagaaaaaaaugggccuugaugcaguaucuaacaagccacaaacaucuuaacuuccuaaaccuuacauagauucuuacugagagagaaaauagauuucaccaaagaaaagacaagguucuuuggggaaggagauaaagacagagaccucuguauuuguuccuccaauaacaggaggaacuuaucaaagaauaaggacauagaugccucauucccagagacuacuuagguuuuccaugaucuugaaaucuugaaagcucaggcagcagaggaaaucaguucaggccuguuugugacagaguggacucauggcuggagaaugagcagagacugccccuguccucugggucuuacuccuugauuuucaggaaccuccucacaaaacaucgccucauucuugccucuuggagcagguuccugugaggacucagacucaggagagcauaucuuguaauuaucuuggcugaggaccucuugaccuuggacagcugaaggagggucugggugcauauauuggccaugucugauuuuacagaaguaaucuucacaggcaugguuugguggaacuuguagccaucugcaaggccacuguagaaauacacaucauuuacuucgagucuauaaaguuuuguggaucaaauaggaaugacuugucaaguggcaacuccuagagaaggaugaaaguuggccacuuccugcuccugguuacucuaaccuccagcuccuucugaaauccuggcaggcucuaccccugagaccacaaagagggacucuuagggucacaccucguagucuguggaggacuagcaucuucuuuugaugaaacugaaaugcaacacuuaauacucucggaagagagaaaaugaaugauaagaauucugacaaccuggcuugaauguuucuauuacaaaauuagagaaacaaucaaauuugaagggacauguaaaacaucacaaaaaugaaucagugguuacugaggagucuaaacucuaggucauacuaaugcauauauguuuccaggucugcugugaugguuaaaauagguuaauauuaauaguuuucagucccauaauaaaauaggucuaagaccuguagugcacuuuauccucuuaaauuggcucaccauguacauggaauguauaaaagaaccagaucaaguguuaucacagauucuuagugaauggaaucugaaucaggauucacaggauuuguuuaguuaauugucucuauauagucauuugccacauaaugauguuucaguaaacaauuaacagcauauacauuuauauaugcuguuuauauaauccauaagauuauaauggagcugaaaaauuccuauugccuagugauaucauagcugucauaaagugguagugcaacaccuuacucacauguuuguguugaugcugguauaaacaaaugugugcugccagucauauaaaagugcaguauagcacauaaaauuauguauaguaaauaaugcuugacaauauuaacaaaugacuauguuacugguuuauauauuuccuucacucuacuuucauuguuauaguguacuccuacuuauuaaaaaaaaaauguuaacuguaaaacagccuuagguggauccuucaggagauacuguagaaggcagaauugucaugagagaugacagccccauguguguuauugccccagaagaacuuccagugggauaagauguagaaguggaagacagugauauugaugacucugacccuguguuggcuucagauaauguguguguuucagucuuaguuuuuaacaaaaaaaauuucagaaguaaaaaauaaaauguuuuuaaaauaggaaaaaagcuuauagaauaaggauauggagaaagaauuuuuugcacagcuauacaauguauuuguguuuuaagcuaaauguuauuacaagagucaaaaguuuaaaaaugucaacauuuauaaagguaaagaacuacaguaagcuaagguuaauuuauuauugaagaaaaaauaguuuuuauaaauuuaguguagccuaaguguggaguguuuauaaguucuacaguaguguacaguaacauccuaggccaucacauucauucaccacucacucacuggcucaccagugcaacuucuaguccugcaagcccuauucaugguaagugcccuauaaaggugcaccauuaucuuucauaugauauuuuuacuccuuuucuauauauaguuauguuuagacacacaauuaccaguguguuacaaugaccuacaguauuccaauacaguaacuugcugugcagguuuguagccuaggagcaauacacuauacuauauagguauguaguaggcucuaccaccuagguuuguguagguccacucuauaugauguucaaugaugaaguugccuaucaaugcauuucuuagauuguauccucauuguuaagcaguacguaacuguauuuaaauauugugacaugggauauauuuuuauaaucuguucauauagcucaggggucuccaacccccaggccacagaugguacugguccaugggcucuuggggaccaggccacacagcaggaggugaguggugggcaagugagugaaccugagcuccaccuccucucagaucagcggcaacauuagauuaucauaggaacgugaacucuguuguuaacugugcaugcgagggaucuagauugcacacucccuaugagaaucuaauaucugaugaucugucacuguauauauuacacguaauaauauauacauguauauacauuauauauuacaauguaauaauaauagaaauaaagugccaauaaauguaaugcgcuuuaaucauuccaaaacugucucuucuccccgcccccaucuguggaaaaauugucuucuacaaaaccagucucuagugccaaaaaguuuggggaccuuuaugagcuacuuauggaguaucuaauauacauaaagcuuagugauaaccagugcaaaagcacaaagauagagacgagauaagcacauaaauaagaccccaaagcugaauaagguaaaugucauaggaaggaacaacaacaacaacaaaaaucuguggguuaagggcagaggaguaauauccaguuggaaaauacauucauggagaacaagaaauuugauggagaucuggaagcagauaaguaggauguuagcaggugacauugggaagaaauaugcagugaggaggaaggagcauaaauuagaggguagaggcaggacacauggaguaaguucauggacaaggcacuccaauuuaaucauagcaugaaaucaacucugugguauguuggcaaucucccuuuuccucacaguucuggaauguuugcuacugcaguuugguuuaguucaacagucauuccuuggauacccacuaagugacaaacacuguuccaaagcagggaaauaaaagauaaaaagguauacacauucuuugcccucacaucacuuacaguggggcaaauccuuugaacuaucaugguuauuggaaauaugcuuggaaugcuuuuggauggagaggcaucccuaacccagccugugaagucagucaagacuuuccaaaaacaaaaugguuagaacucagucuagauggacaagaaggaauuagguaaaaaacagaagcaaagguguucaaggcacagggaagaaaagcaugagaaaaagguaugaaacagcauuugagcucgggaaacuauaagaaguucaggauuccagaagcauucauucaaguaauuucuaaggagugucauuauugcuccaauauuugcuuuuugaugugaaacugagaaauauaauuauauggcuuucaugguaagcccacacccuuuacuaacuuuggaguuacuaaugguauuucauuuuuagaauaccuacguguuuguguuuuauuguuauucuaccacaugaugauuuuguaaacaaacauugcauauauucaauguucccugaauuucauuaccuugacucaaugagcuuuaugauuguaauacuauugggcaacauacccaagaguuauaagaaugcccaacauugagacguuugcagcauucccaccuucuuguuuuguuaaaaaaacguauugccuuauaagugaaucuaaguauuauucacacaaucccuuaguauuauauacuucucagucccaaauaguucuuauguucucacuacugacaccuuaaaucucuauaauauuauuugugugucccuuuuuaaaaaaacacugauaucuaaauacaugaauagcaaaaguauucuuccuggacuauacuucuaucuucucugcccuggucuaauaauucucuaucuuugaaguacauuuucagaaagcaaaauuuaaaucaagacugucauuucaaaauauagggcuaccuacaguauggguauguauaacuaaauaugcugcucaguggaccaggaguucagcccaucaugguaaauagcaugugugacaccaggguuucacucacugcucaguuuuguggcaacuguggaucacuguguaaccucagucuucguggcuucucauuuauggggcucugcucagcuguaauggaagcaaaagaugugaaaucagauaccacugaaaauguuuaucuguaugaguaaaagccuuuuacucucuugcuaaguuuuuucacuaugcuauuuauuucuauuuuaaggaaaguuuuuuuaaaugauacguaagucauuuuaaaaugguaucuacacacaccagauagaaaauuaaaggacaugaauaauuuaaauuuuaaaugcuuccuuugguuaucaagauauuugaguucucaaauguuugaauaguugcuucauacucaacuccuacauguauacauaguaaaagagaaaaaaauccuuugaaauguucauauuuuccucuuaugucaacauggauaugucauaauauuuuuuguuuuaugggacucauuuccaguugaugcagaauuuuaaagucaagauaaucacaauaauuaaggaguaaauguguaaaugagggccugauucaaguuauuuaauuaacauagauucauggaaauuugacaacuggaggauuaaauauggauuuucaucuaaucuguuucuguacuuuucaguucuccuaaacuaucaccaaauaaagggcaacaguagagaaucagaaaugugaaaaaaaauuaggaagcuauuuccuguuccuuuguggcuugucuagucuaauacuccugcauugagaaguucuuagagacaauucuugugaaucuuuucuaugugggggaagugagaagacggagaaaaauggcucuccucccuaaauauaguccuagugguguugauguuaaccuguucaggauagaccaagcccuuuaguaugaacgggagcccugggucccccaggacuagguaaucauugccuuuuguccccucuuaucacaggcuaaucacuuuauuccuccuggauuccuccuguuaaaaaucagguaaaaaagcccaauggcagcaauuaaaccuaccuuccauuccaucugaauggaacaggcuuccaacaauguuucucucaaaguacaaacguuucucaucucuauucccacuacuacucccuucaccccuaaagagucccagacagaauuuucagauucaggccaaaucccuuccauuuacuuccacagugaucuuccuugaacacugcuuuaccauauucuuacccugcuuucuucucccuccaauuggagagaaccaauacuuacuuagggccaaauaaacuggcuaaucuauaauuccaaacuaauaauaauguuaaggugauguguuggggguguuguaccagccuaaagaaagcauguugggagagccucuuuuuuaugggaugaguuggcuuaucuucccuagacacaccaaaaucaugguagaggaacccggcaugggaucaucaggaagaggaaguggggcagugagauaauaaguacuaguaugaacacugaaucugaagugccaggaguucaucguggugaaauugucuagaauaacaaauauggauucggagcuuaucagggaagucuggucaugagaguccucagggaugcuuagggguuuacgagaugcaagguuaugagauggccaaggauggguuuguaguguuaagaggagagggcuagagacagauggaggaggagcuaagaguaggagggcaaccaggagagaagagugcgaggaaucaagggaggaaaguuuuucaggaaagaagaaccauucaccaguuuaagucccagcgaggccaaguuagauuaagauuaaaaagggaaaaggggaagagagaaauacagaaagcaaguagacuacuuaggcaaaugagauuuucaguaauaaaagagaacagacuucuauuccucaaucuuucuuuccaucuucaccucauauuuaucuccaaacaaaaccauauuucuacauuguuugucaauauuugaauuuaucaauuugaaaaaaauauuuuuaacucuucacaacucccacacuaagccuaaggccaaaucuuuguucuguugaaucccuuuucuccauucccacccauuggccuuuucuuugcccugauguguuucucauguugguuucuccucuggccuaugugcaacguaccugccagauggacauuucugcauuaugcacacuugguccaucuuuuauuuuuacuacuuucauuagcuucugcuuuccuuuaguaauagauucagauuuauuuuccacucugccuuuaucuucucuugauugccauuuuuugagccuucuuuuccuuuuccuugaccaucauuccaucuuguugucugauccccugaacacuugucaccuggcacuuucuggcaacuuccaaagccaccccucugaaacuuucacuuuucuucucuugucuuuaaaaaaacuuggcugcuguauuucauuaaugaauaugaauaggaagcaaguuaaugucacuuuaauauuuugauuuagauuauccucaucuugaccaaauguugcauuucauguguauaauucaaaauauuucaguguugucuauuuuuucuuauuuuguuuuguuguuuguuuguugguuguuuuuuccucaaaacucaggcuaggcccucacaugaacguagagaaaagaguuugccugggcaauaugauuugaagggugucuuaaagcucaguaacuggucacaguuacucaaguacuuauuauucucugccuuucaauugaauugaggcauuuuaacuucuaaaaugcuaaaauaauuucuuaagccacuaggagccaugaagacaucagacaggguuauauuuacaaggaggguaggaagaaauuugguuugauugaggcaagaauaaagauggcccaggaccgaggaguuucccagagaguacaagcccuggggccacuagaguggagggcucagagcaacuaaagucagucgaacacuucagguauugggggaagggaagggugaugcuaccaucaggagaggauguggaagugagacaaggguaaaaugaaaagaaacuucucuuauaucauugguuugccucaaugaauaagucuauuuaaaagggguuccuuuugguuauuuuuugaggguuuuauuuuuauuuccuuuaaaaugaauauuuguccaauuacuugauaaaggaaggaaggguaugaucuuuauagagauccucuuuuccaugcagcacacuaauugcagggaaaaauauaggaaacauuuucugucuacucauuuacucauuuaugcauauacccauguacuaauuaaaaaauuauccagggccgggugcagugguucaugccuguaauccuagcauuuugggaggcugaugcagguggaucccuugacgccaggaguuugagaccagcuggccaaccuagcaagacuccaucucuaaaaaaugaaaauaaaaauaaaucauugugaaugugaugugugcuagguacuuuggcauuuuaaauaaaaugguaaauaagacacaguuccuaucauccuggagucuaaaguagugugcauggacagauaacaaagcaguuacaguccagcauguuacgugccaugaucagagaaguacaggugcuuccuggaacaagagaaagggcacuccaugcagauuaggagcaacagcaaacuucacagugggaaugacaucuuaauaggaguuggccaggccaggcuagagggaaggggcagagaugugaaggugaagauggaaauaauauuccaaacuggaaaacagcaccuguaucacucaaggugaguaagaaugugacuuucacagacauaaacaauguugucuguggugggaagucaaagucgaagggcuaaguagauaaaagaugagagucugggucccaucauaaaggccuuuugugggcuguucaaggaauuuauauuuaaccugaggauaaauauauggagaaucauugaaagguuuuagauaguaaaauaaugucaucagauugcuuuguagagagcugauucuagcuaaaagagguaguauuagguggguggaauaggagacugcaauaccaauuuggaagucacuguugcagccauucuagccagagauaaugguagucuaacuuauauuaccaagagaaaggacucauucaagagauauuuauuauauaguagauaauaucaauaggacuuggagguuuaugaaaccagagaaaaaggaaaaucaugaugcccaaauuucuccuauggccacuagaugaaugcugucauucauugagauggagaacaccagagaaaaauccuuuuguggggagagagccugugaaacacccaagagucaaacaaacagggguuacaauccuaagucuuuggucaaguuacuuaucuuagagugccucaauuuccuuaucuaugaaauggggaugauauuaccuauuucauagagcuauugauagaauuaaaugagauaauguacauaauguauuuuauacaguaaucuggaucauauaaguauucuuaauaauuaauaugauucauauuauuuaaaacuuuguuaaggugguaguucuccauggcauuuuuacaugucuugugauggcuuuugucccagacuaucuguucaaagagcucugcauagcagacagccucaagauagugagucccucaggguagaaagcagauuuguuucucuacugggauaauaaagauaaugacuccuuccugggcaaagguugggcugguuugcuagcagcccccuaauaagauuggauuucccaaacugagguuccuuagcuaugacacaaauucacuauacaugcagcauccacuugggccacucuguauuccuccugugagacuugggaguggggugaccaaggguaucccguguaaauguggagcuuauguugcccauagucccaugaguaauuaaggucuuugccugucuccuaauagccucaugucuccugcuagcauuuaugaaaccuuagcaggcuaucucguuagcuuaaaagcaagggaaaaaucucagacucuucacguuucuugaugaaguugucuccuaaauguuuacauguauguuguaaaaccuugauacaguggcuguguaagacgcuauuuuccagucuugacauugaacauuuuccauaaaucugauuaugggcaauauauaaacaaaacuguaugaaacaagaguguuuauuuucacuuugaagaauucgaucguuuugcuuauuuguuugggaaaaguuugagaaacacaagauuacuuugcguuuaaaauauuucuucuuucaggcacaaauccaugggggacaaauguuuaucguauaaauccuuacuaucuaauaaguacuaaguaucacaaguauauguugaaaucauacaauaauuuuacuauuaauagcaaucauugaauaaauagcauagauuaaggcagccauuggcuagcaaauuccaccuauguauuaaugaagaguaacaucguguauucauauauaucagauaaucucucacuuaacuugccaguguuuauucagguaugggcacauaauuucuaaaaggcaucaauuuguauucauguacguauauauaaaauaccuaguuauaucugagaacauaguuagggauaugcucuguaagaaaauaugaugauccuggaguuaaauaaaaugaagaauguucacuuggauccaauaugaucagaugcagauaacauccaguagggaacagggucugcaaacuacaaaaaaagggcaaaauacacagauaagagaaaaaaugaguuacagguaggacucaagauaguggacaaaguauacggaagauagaucuuacuuuaauaauccaagacaagaaugagaaggagaaguaaaagaucuagcguguuuuaauagaggaagcuggaaauacaguccaggaugggggcaaauaaggccuuguucagggaaggcuuccuagagcaaggaacacugaccaugugaaggaaggaaucagcgugauaacaugagacccuaauccagauaccaaaggggugacuugggagccuaauaacccuauguuucuaaacaccagaagauagucacucauuugaaggggagaggaauaaaaccacaaagaguuuguaaaccaaaaugucuauaacauguggagaaacuuccaugcaucugaguuauugguaccaagaaggggcaguuuaguguucuuaaacuaaaggugucauucuuuguggcacaggugaaacccaagcuaaauuaaaugaacaugaaacuacacuaauaguguuucuaaacuguauaucauuuuaaguuuuaguuguauucuugagacaucucuggacuaaagaacagacaaagaguuggaaaaauaauccacugagaaggccagagaaaauauaagccaggaacucagauuuugaucuuuguugauaguauuuuugucucucuuauuccuggguagugguagacaagauggggcaauaauaaaaauugcuuaguuuuggagacauggccaaaaucuaaaacacuaucauguuuaaaauaauuaaagugucaggcauucuuuuacuuguacacuacaucuuuguuuauuauucuguuagauaaagccucgugucauuauacuccaggcaaagcuguuaacaaggaaacuaaauccacacccuagaccuaauuuuuuaauacaguuucuucuuugaucuauugcaucucuguauuuaauuaugaggucugacuugaugccauuguaucuuuugcucuucuagcucuuucuguaguuuguaaaaaaagaauuuucuguuucuuuuaaagcaagcucauuuuuaguuaguucauugaaagguguaaccuucuacuucuuauugcuccuuggguccuuuuauucuuugucuccugaacugacacaauuaccaccucuauauucugcaaauauagcuugcagagccgguuuccuaagaauauaauuuucaaaagugccagacauaagaaugacucuaaagccauuugaugaguucacuguuacauuuccucauuugcuuccuucccaaagagauuuugauuuuugccuggaacaugcuuaucagcuuaaagguaugcagcaucauuauguuauaaggauuuucuucugcagcagcaagugcacuagccuugaaugaagcaguugcuaaucauguugcacuaagcaaauaaaagucagaaccgaccuaaucuugcuugccuaauaccaguuucugcugcagacuucaguguaauguucuaaucacuggcgcaaaacagccaauuaauuugccuucccuacguguuuuuacuggccaagaugcauaggggagcagugcguucggucauaaucaugcuccacaaagaugggaaauguucccuuugagcuuccaaucauuaggccagcugaagugaagacaagcccauugacaagugagaauggcaauaauuuauuuucuauugauggguugugacaaaucaugucgaagcaguggcugcauacuguggggcucugcgaaggaagacugugaugggcaaagaugaaacccuucacagcucauuuaguccaaauguagccaccuggguggugaaucgguucaacauaccagcccaggcauuccagcacaaaauuagaucacuaacaggcaggccauauagggauuccuagaagacauuaaucaacaggguugagcugucaaaaugcagaguuugaaauuaagaaacaccaaaaggaugaaaauguggcaaugcugucaaaaaaaucaaguaugugaugucuacugcaggauucuagccaccauuaaaaaagcuuagaagaaaaauaaauuauaaacagguaaagaaaggcauuacccuacugaaaauuuuccuaacauuuuuacacauguuaauuaguaaaagcagcauaaaaaguuaugcaagcaugagcacaacccuuuucaacuuaacacugacaggucagcuacauguaaguccuccuuaccgccccacagcauaguucgucucuuauuuaaauuucuuuucuaccggaccuacugaugugcaaagcauuugaugucucacccugcuuaugaauaccaacauugcaaacuacagaauuuuuagacuugcaugguucauuuucugaacacuguuuuugguagaauagagauuucuagaaucuggacuauucagggguguguguauguguuauguguguuucuaugauuauauuuuaucaguaugguuuucuuuaaaaagcucauugucuguuuucauguuauaaaaaacauuuaaugcaauaaacaaauucaaacagucagaguuacugaaacugaccgaauuuucacugagcaaaaacaugaaaacuuccauuaccuaaaauuauaaaauuuaaauccugaagaauuccuuuccaagccccacauggguuuuuucuuaaaguuuggucuguggaccacaaacaucaaaaugaucuagagcacucacugaaaauguaaaugcacagaccaauaucccucagaccuacugcauacaaauuuuugggaugggccugagaacuagaauuuuaauaggauccccagagugauucugaauguacagaaaaacuugaaaacuaccuauucuuguaugaauaagcccuggcccguuuucaaguucaaacacuugcuucuuuccagcacugucuaacacaucucccucuuggacaagcuaugcuccauuuguucacaaacacucuaauacguucacauuuccaugccuuugaucaugcugugcccuucaucuagaauuccuccccaaucuccagccccagcuccaucuuucccauccucuaagagucagcucaaaugcucacucccacaugaagccuucucuguaacucucagcuagauguuaauauucuggccucugugcugucuuagccuuuuguuuguguguuuucuagcauugccaccuugccuuucauugcaguuaccuguauaugugcuuuaucucccaaagaugguucacucugugaggcucaugucugguaugucuguuaacaucucauagcaucuaacucauugccucauauuauauguacaguaaauguuuguggaauugaauuguugaauaauagauguuaguuaauucaaaccuaagcuuuaugcuuuuaagucagucagggagguaaguguucucccuugcuuuaugcucagaauucucauuagcaucuuggacugaguuuaccugugagcaaaaauaaaugaggucuguuauuuuauuuauuuguuuguuuuacuuauauacaguuugucugucaaauacuauucugcuuuauauuuucucuauuagcuuugaugauauuuucccugaaagaauauuuguugauauucuaagucuucaguugaaacagauauguaaaguguauuaauuugcuggaaaaaauaaaugaccuuacagcaugcuacucuaaaccauuuguuuuauaaauauuucagauauucaugggcuuaaaaaaacaaaaacacaggaacuuuaugcccuaaaauauuugauagcucuguaugaugauuaaugaacaguucggcaauuguucaacuaugccuaacuuaagacuaauaucuuauaucccaauauagcauaaagcauggaagccaugguuuggcuuuucauaaccuaaggaacaaguucagccugacuuuaagguaaagaaguguuugacugcgagccccccuguauucuggaagcacaagaaagauuugaaagauacagggcaaauccuaucaguuuuauccagguucuugaaaguaguauggucugcucaauccauguuguaauuguuuuaaaaaccccuuuuuaccuauguguuauugugauauugcuguguguuuagacaccacggaaacauaugcgugaaauguugccaggauacuugagaauaugcacuugaaaaaauaaaauaauucaagcuaauuuaaguuaaaccuauucuagucagaagaaugguccuuuaucugucuuggucuucaauuacaaacacucuugaugaggaguaggcauugaggaggugccucugacuuuauuugagugccaaagaucucuggcagacuagaaccaggacagggcugcugggaaaaguucugaaggugugggaaaugauucuuucaaaaagaaggugauauguaaacuuaccucuuugcaacaccugggguuguuuuagaacugguauaaaaaaugcuuucuggggaccacacauuucauaaauguuuccuucacuguuuaguagacaucucaguggguucugcuuuaacucaguugaugauuguaauagaacagaguaugauacugcauuuuuauuuauauuagaauugcuggccaugggcaccuagggagccccuagguauaacuaaaaccuaauuaggagaaaagaacauugcuggcucaauuucugaauuggagaguagaagaaacauaauuccuuauauaacaacauaaaaucauuucaaaauaaauaacuaaaaaugauacuguuuuggaaauaugcuuuccaccuccccaaaccagaaaagaacagcaaugugguauugucuauagaauugauuugaucuuccgcgaguuccucuauucccaguguauauaagcccuaaaaccguuuuugcaaacaucuuaugucacuugaggguggaagaaaggaaaaguuaguccauaaaugguugauguaaagugaugagaccuuauaggagagacugaaggauugugacagacaagcacugagaaagggaaagagauaaaaagaaaccauagugugaguuucaggaaaccuuugauguguaagaaauaugugggcauuagauuaaagguucucaacauugaccucauaauauucaugauacaagaauuagaagagccuuugaagaagauaauaagaauaaacauacagucuucuuugaaaaacccacagagcacaaauaaacaaauaaaaaucaaucuguccuguacaagguauccugcuuacuguaucagcaaaaagaaaucaacuuugaccuaugcauaaaaccugaaggaaaaagggacuauaaacaaaaggcaaaugaagaacauaaucugaagaggaauggcacaagagaaacacagaaaguauucaaaaaaauaguucuccagagucucuaaggaauuacagacaacacagccucuagaaaacaaucuaaaaagacuucaaaaacgugacacagugaaauaauggaagaugaaaauugaucuggaaaacucauaaagaaaugaaggagaaacuggaaaucauaacagacauaaaagccucauuaaaggcaauaaaaauuagaauauaugcucuucaaaacaaagucauagaggcuagaauugagaaauaaagacaaagaaaauaagccucaaaaaccaaauuagguuaaaagaacuauguaaaaauuacuauagagaugauagaugcggcagagagaaaaaggagaaccaacaaucacaaaauuacuauuucugaagaaaauaacggaacaaaaaaacuaacacauaagaaaacuuuccugaagaaagauuugaucuguauagugcaagcauccuuuauaucggaaaaaaaaccuuaauacaaaauaaugcuaaaacauaugcuaauacaguuucuuuguucucuaaggauaaaauuauaugggcauccuagcugacaaagcaagucauggaauaggggaaaaucaggugcgucuuacacuuuuucagagcagcacuggcuacauagcagugggucuauggcaacauuuccagggcaagaaaauaugauccgaaauauaaagacaacauucucaagcagguaagagcuuagggauuauggcauccaugauaauuauuacaagcaagagaugaaucaaaguaaaauacuauauaaaauuaucuaagauugggccgggcaugguggcucacgccuguaaucccagcacuuugggaggccaaggcgggcggaucacgaggucaggagaucgagaccauccuggcuaacauggugaaaccccaucucuacuaaaaauauaaaaaagugguggugggcaccuguagucccagcuacucgggaggcugaggcaggagaauggcaugaacccaggaggcggagguugcagugagccgagaucacgccacaacacuccauccugggugacagagcaagacuccgucucaaaaacaaaacaaaacaaaauauauauauauauauauauauauauauauaugauuaaauagucacagaaaucauaguuaaauguuauaaauccugagaguguaaaaauaauuacacauacccacagauacacacacacaccaacuaccaaaggguggagaaaaagggaagugauggaaaaaaccaugauguacaucuuuuacaaucagcucucagaagaugcuguuuuaaguacuaauguuucagccacuuacaguucuuucauggugucuuaaaaauuacauuuagaggaauuuucaaggaauucuaccaacucauagugaagaaacguuucucugaauucccaacaauuuuucucuuucacuucauuuuuuucuuugauuaucuaugugguauuaaaggcagcaucuaugaaauugucccauuuuuaaaagauauuucauuuccaucccuuugucuuaguauuacaggugucuggaaagauguucaccagauauggaaguuauuccugaauggggaacuuuugagugaugauuaacugcccccuguagaggagaggaggucauaugaacaguuuagucagagaauaguuuuaaauacccagaaaaaugagguauauuuuugaugcugucuuuuguauauucuuccauuucauuucucuugaaggaaaaauaaaagguaaaaccauucaaucagcuuaugcaagaugcucacaguggcacacuguuaaucuuugaaggaauuacaaaggaagcuaaagaaauuuauuuuuccauaaauaguuuacaauuuaacuugauggucuuuaguuuuuuccauuuguuuggaugcaaugcuaacuuaguauaacagaaaaaggacucacaaagaaucgaauggugauauuuuuagguagcucucuuauuccucauucacacauaauccauggcucucuuauccaaguaauggguaauuuuauauuuuggaacuauucaaaguauaaggcauugucuuggguaacuacuuuaaugugaacuugaacucugaaagagaaaaaugucagccaaaacuauaaugccuuaaauauauauuuggcuauuugucacaagucacuauuuugguuuaaaggaaauccuuaacugaauuagcaauuaucaaagaaguacaaauuuguucuauuugaauaacucccauuuccccaauaagaaaaacuaaugacuugaccauauacuguggccuagauuuuguaaucuguuacugcucuaaagaaaauuuuaagcugaauuaguuauucacagauguaucuacccaaauguuuguuuauagucauucaguuugauauuuuuucuaaauauacugucacguugugggauucuguuugcguagcuauaaugggguuaacuuuacauuuuuauuuguuaacauuuucaugauagaagcugaaauuuugaagguuaugauaucauuucaagauugucaaagcucccaguuugacauauuauuucucaaaguguaucuaaaaagagaggaugauggaaggaaucagcaguuacagaaguuuguuagcauaaaauauaugggaaggagaugaggagcuguauuuaauaugaugaguaauuuacaauaucugugcaaaucagauacucgaguaucuguuaaaugggcagucuuccauuugauugugaauacuuagcuaugaucuaaucuuuuuccuuuucuuuuuuuaaaaguaaauuuaaacaucuggucccucacccacuagauguuuuuacucaguuuaauugcagauuggaaaugcuuuccugaaaucaugaacuuuuauuucuuaaaauuaauugugauacaaucacaaagaugaucauucacagugagggcuauauuaacacuuuuuaaaugguuaauaacacauugcucacuguagcugcuuuugcaacuuuuaguuuuguaucuuauuuuguccuccaagguaaaaugacggagugagcauauugcauaaaaacuaagaucaucacucuuccacugccuaucacccuguuuaugcuuaaccaagcauuuauuuauuaguucuuaaugguaagggcuacaagguuacuacaccugagagaaaaaucuguaagacaggcuuucuaauuaaucacugggaggguucaggaaggucuagcuauuucuguaaaccgaagcauuuaugcacucuauugcaaacguugaucaugaaaauggcagguaaugcuuuauuucucuaaguuucuguaguuccauuaggaauaaugaacauuuuacaugucucucuguguguauacauggaugccaucauuaaaacuagggccuuuguucaccugaggacagauagggguacaguucuaagaaagccaaagaguaguaccaauaucucaggaaugauaugaaauggugcucugaauugaaaaucaccaucucagaacaaaaggcucugagaaagaauaaucaauagcaacagacucuguuagucaagguuaccauauccaggaucauuuguggcuagucaaguugucuagaccaugugccucauuggguaauuuuccuauguucacaacaaaacugcuaugccauuugcagcagagcuucaggugaaauaauaacuuaauugauagggaugaggcucuuucccagauuggccugggucacugggugcaguaagaauacauaagauggcaccagccccagucauauuuacagguuuauucaggaacugauauuucuuuccccaguccccagcaucugcuuugguguuuccuggugcagaaaccuguacagucagaaccauaaagcauugcagaucuuaauagccuauuccuccugcugcuagccaguucccugacauuggcagagaucaccacccuagccacaccgcugguauaauuuaucucuuaaacacaguaauguugauuucugaagcccagcacacguaaaacaguacacagagacgcauccucacucugccuguuuucaugucccucaaauacaauauagcaggcuaggaccucuaaucuuccccaccacuacccuugugauuuuucuguucuuccuccccuucauccuuccucauuucuauaauccuuacauuugugugccaguugcaggagaacaguggcuuuuaaguguuguacagccaugcagaugcuagcccacugaccaaauauucuuuggcuuugccaaauuuuagucaggauucugaaaauucuccuagguccaucugugcacuuccuuguuaaauccaguuuuagcaaaagaaccuugcuaaaucaguuuagccagaacccccuaucuuuaauaucugauuaucuuagauacucucauccucuacccaucaucccccaagugacgucugaucacccuggcuugucuucagcaagaauccugauaggucaguuuacccagaagacccuuuaccccugauguuuccacuuaguaauuaucuauccacugacccccacacugcuccuuagcuauaaauucugauuugcccacgcuguauuuggaguuaagcccaaucucuguccuucacugcaagaccccauugaaguggucccuauaccgaucacaaugguucugaauaaaguuuuccuuacugagcuuuaauaaguuucaugguggggcgugguagcccacaucuguaaucccaacacuuuaauccaagaccagacuggguaacauagcaauaccucgucucuaccaaaaaaaaaaaaccaaaaaaccaaaaaaacaaaaaaaaacaaccuuuuuuuuaauuagcaaggcaagguggcaugcaccuguauuccaggcuacucagaaggcugaggcaggaugaccacuugagcacaaaggaucaaggcugcaguaggccgugaccaugccacugcacuccaggcugggugacggagcaagaucgugucuuaauuuuuuuuuaaagugucauugaauaguuuuuuauuaacacaacuccuggcaagacuaagaacaaggcuguggauacugaggccccacugcauuuuauuaaaucuauuacauuaauuaauuuaaucuuacauuauacaaauguauaauaaguuauacauuuauuaaaucuauuacauuaauuauuauauuaauuacauguaaauuuauuacaucuucccagauggccacugcuuucuguucuuuuauagcugaugguucugugcgucacucucagagucucaagcaccuguuccuuccacuucaaccaaaauaguucuauuuuuuaugcuuuacauauuaugcuuccacaaaguauuuuuaugcagauacugcuacaguuuaauaaaaagaacuugaucuaaaaaguuaaagaaauuaaucacuuaagguccugauauacauauauauauauauauauauauauauauauauauauauguuuaaauucuauauuucuagagaaauagcagcuuugaggaacaauggaccuguguccucuaagugaggaauauagcaggaaaaaagaaaucaagaaaaaggagcgucaacauaaaagggagcagaaauuuaaggaguaggaguaggagauaauaguuauacugguaugggaguugucuuucuuugugaauugguuucaguuugguuuguuuugcuucauuuuaggaaaaauaaggauaaauaguagaaugagauguguaaccuuauccaguuugcaggucaaggguccugaguucuagugcugguucuguuuuauuuggaugacugccuacccaccuuaaguagcccgcccccucccucaaauauuuccuauuuccuuuugccuaguucuauaagcauagaauggucaugauaucagaaguuuagcaguaaggagaaagggccaagauggcugacuggaugcaacuaggaagagcuucucccaccaacagagaaaagaacaucaaguagacugacacucugagcagaucuucgaaaagcaggcauugagaguggauagaggaaggaugcagaccacagggcugacaggggaggaagcuagaaacccugcacuggguugccaagcacuaaggcuuauuccuggcccugaggagcuccuaggaaaggggugaguaaaauugguguggagcagcccacucuuaucacggaucuccaggaucauagcuaugggagaccccuaugacccacacagacauuugaguuggcagggagaacuacccagagaguuggcagagacagaacuccaguuugcauggagccuacaagguuuggcguggggacagcugcaguggaacauggccgugggugcccaaccccaaggcucaccacucuucucuagguggcuauagccuuuguuagcugccagaccuggagagaauagugcuguaaugccugcaggacugggccagucuggucugaaugacccucugucugccagucucucccagggucccugucuggccacaccaacuuacagcacagccucagcuuccccacuaaagcacuuuccaguggccaccaccacaauucuuuagcugauagcugucgcccucccaucagagugcuuuugcagacagaccuccacuggugcgcacuuugcugcagccucccccgccagcaugcacuugccugcagcaucccccaacugacauguacucacccacaggcuccucccaccaucccaccagcacaugagugcugccacacugguaugcaugcaugggggaacucaccacugccucacugauacacacaugcccacagccaccccacuauuguacguguguguggucccccaacuuccccacugguguacacacacccaugcccccaaccacucugucaguaugcaguuacccucagcugccucacuggugcacacuugcccacaccccccuuccccaucagagcacuuuugcuggcaguccucauugggguguuuuugucagaaaacugggaguaccuuggcuccucuggugcaacaggugcuugaccuugagggaccagagaacaaagccaagggccuggucccugccccccaggguuagagcacacagcccaggagugcugagaaaagccuuggcccccuggaggcaugcagaaauuaagacaguugaauaaacccaacuuauacuacaguaaaccuucaagggcacaaaaaauauaaaagcaaaaagccccaucccaggacauucaaaaagauuaaaggaacaucagccuacacagaugagaaagaaccaacacaagaauucuggcaacucuaaaagcgagagugucuucuuaccucaaaaugaucauacuagcuccccaccaaugguucuuaaccagacugaaauggaugaaaugacagauaucgaauuuagaaucuggauggcaagaaagcucaaaaagauacaggagaaguuugaaacccaaucuaaggaaaagaguaaaaugauccaaaaguugaaaaacaacauagucauuuuaagaaagaaccaaauugaacuucuggaagugaaaaaauucacaacaggaauuucauaauacaauugaaaguguugauagcagaauagaccaagcugaggaaagaaucucagagcucaaagaccaaagaccaccccuuuguuguuguuguuguuuacuguaaguuuugggauacaugugcagaacguaccgguugguuaucuaggcacauagguguacaugugccaugguuugcugcaccuaucaacccaucaucuagguuuuaagcccugcaugcauuagguauuuguccuaaugcucuccauccccuugccucccacccccugacaggccccagugugugauguuccccucccugugucccuguguucucauuguucaacucccacuuaugagugagaacaugcaguguuugguuuucuguuccuguguuaguuugcugaggaugauggaagaccacuccuuugaaucaauguaggcagacaaaaauuuaaaaaaaaaaaaaauuuaaacucucucucuuugcagacaauaugauucuaccccuagaaaacaccacagucucugcccaaaggcucuuagaacugauaacuucaguaaagauucaggauacaaaaucaaaguccaaaaaucaguagcauuucuaaacacugauaacauccaagcugagagccaaaucaggaaugcaaucccauuccgaguagccacaaaaggaauaaaauaccuaggaauacagggaagauaaagaucucuacaauagaaauuacaaaacacugcugaaagaaauuagagaugacacaaacccauggaaaaacauuccaugcuuauuaauaggaagaaucaauauuauuaaaaugucauacugcccaaaguaauuuucagacuuaauguucugucaaacuaccaaugucauuuuacacagaacuagaaaaaaacuauucuaaaauccauauggaacugaacaagaaaccaaauagccaaagcaacccucagcaaaaagaacaaagccagaggcuucacacuaccuuacuucaaacuauauuacaaugcuaugguaaccaaacagcaugguacugauacaaagacagacacauagaccaauggaacagauuagagaauccagaaauaaaacuucacaccuacaaccaucugaucuuugacaaagucagcaauaacaagcaaugaggaaagaacucauucaguaaguggugcugggauaaccggcuagccauaugcagaagauugaaacuagauccuuuccuuucccuaugcacaaaaaaaucaacucaugauggauuaaagacuuaaauguaagaccuaaaacuauaaaaacccuagaagaaaaucuaggaaaugccauucuggacauuggccuuggcaacaauuucaugaugaaguccccaaaagcaauugcaauugcaacaaaaccacaaauagaaagugggaccuaauuaaacuaacaaucuucugcacaacaaaagaaacuaucaacagaguaaacagacaaccuacagaauaggagaaaauauuuccaaacuaugcaucagagaaaggucucauauccagaaucuauaaggaacuuaaaucaacaagcaaaaaaacaaacaaucccauuagaauauguacaaaggacaugagcagacacuucucaaaagaagacauacacauggccaacaagcaugugaaaaaaauggucaacaucacgaaucauucaagaaaugcaaaucaaaaccacagugagauacuaucucacaccagucagaauggcuauuauuaaaaagucaagacacaccagauguugacaagguguggcaaaaugggaaugcucauacacugcugguggggauguaaauuaguucagucacugcagaaaacaguuuggagauuucucaaugaauauaaaacagaacuaccuuugaacuuagcaaucccauuccuggguacauacccaaaggaauauaaaucauucuaccaaaaagacacaugcacuuguauauucauugccacacuauucacaauagcaaagacauggaaucaaucuauguggccaucaacaauggauugaguaaagaaaaugugguacauauacacuauggaauacuacauagcuguaaaaaaaaugaaauaauguucuuugcagcaacauggauggagcuggaggccauuauccuaaguaaauuaaugcaggaacaaaaaaccaaauacugcaaguucuaauuuauaagugagagcuuaacauugaauacauguggaaacaaagaugggaacaauagacauuggggacaucuugaggugaaaggguggaaggaggauaagggucgaaaaacuaccuaucugauacuaugcucauuaccugggugauaaaauaaucuguacaucaaacccccaugacauucuauuuacccauuuaacaaaccugcacauguacccucuggaccuaaaauaaaguuaaaaaaaaaaaaagaaguuucgucaguagaaaauaaagcagaaauaaagggaaguggaacagaaauuacaaagcaaaagaagauugugaugauuuuaauauuuugauauuguauguuauuaugcuugaugacuuaguuggauuccuccaaaagcugaccucaagauuaggauuacauuguaagguuauaugggaaguacagggacauuagcaggggaguagagcugauacaggaaaaaauauguagccaguagugugcaaaauuaagccagcuacccaaugggcaagugaagcuucauucccuaaggaaugccuuggaaauaguauaaaacacaccucagaauuaaccuggcuaaggaguaagggagccgagguccguauauccccacaaccuucauuuucagcuaagggcuacuuagcugaaaucgcauguacccugacagaguagauuccaacagccuggaagcaacccuccugcagagaugcaggugcuggccauuggugguugggcugcagggcacagaauugguaaggggcacugaggggccaugggcagauuuccaacagcaucugccacuguugucacuuaauguauccaugaguaagguuacuaccuagugagguaguaaugcagccauauccuguuaaagaagaaaaaguuugaagaaaagagcuaagaaucaugacuuugguaacuaaauuuuucuuucaaauguuaauuuuauacaacuuuauauuacaugugacuauaacauaugucccuuuguuggugauucucaaauguuucaaacuggauaaaauuaaauuuaaaaaaaaaaagagcucuugucacuuuucuuaccuaaucagaauuuguguagugaauuuaaaaagaagaaaaaaaaaacguuguuacaauuuuggagccagggagcauguguuuaaaaggaaucuccuuuuuuucuauaugcuuuuccuuuuaucccaacagggaaccuaaaucuguuuuaauugcacacacacagacaaaaagucauuuuguaucugccaagugugguaccuuccuuuguuuauuugcuauuaaacuguuuuagaagaaaaauaauuaauuuuuaaauuugugguaauuauuacauuuuuguguucuguauugaugguaugaaauuaucaauucaaaaaucugcauuagaauuuauuggauuggcuuauagaaaucauugaugcuacacuuauguauucauuuauuucugccuuaucuuguuuggaauaggauuuaacuauaacccagauuccuucauagggaaaucaaauucaagaauuugaaaaauuagcuuaaaggaauuggauucagucagucaccacggggaguacagagauuguuaauuuguagucagacagaaguggguaagaauuuuaccuccuccauuuugcguugugaccuugaguaaguuaccucaucucucuuaaacucagcaccguuaucucuaaucuggagaauauuaugaaaccccacagagucaucaugaggauuuggugaaaugauguauggacaguaccccagugccugacaugcagugcaguauauacuuagcuagaguuagcucuaagaaaagaugaacacauggcaaaaaauacaagacagaagugauuaaaugcuacauuuuguagugcagacauuaagugugaaggaggugagagaucacugagagccaaaguaaucagagaagauuuuguggaaauugaauauggguccagaaauaugugaaggauuuagguuaggggaaugagaagauguaaucuugauagguaaaagcagcagcaaggaagagugaauaauggcaaagcaggaagagguaaggcccaucagauccagacugucccucugcggccuggugguggcccugacagagacagauggguggccagccguuggcuuggagguggaauauucacuccacuuuggauuucuagaauuugaagugacaagaagauggcugagugaauacaccucacauagcuggagaagggggcagguauuccaaagagacuacuauuugggggucacuggccucauggugauaguuaaacucagugagaucccagugagagagaggggagaaagcauacccaaggacugaauuugcugaggaugcuauccacugucauagaauggaaggcagagggacucaaucagaaauaaacccaccaagagggguggucaggacaugagaagaaaagccaggagaguggugugaaggccaauaaaagaauggcuuucagcaugagggguuagcaggagccuggggagggcagagaggagacauugucugcaagcagcugcuuccucuccuaggaaaaauaaaaccaguaucuccaaagugagcccuggaaggagaaccuuugucuagggagggaaauugaccagcuguucugucucuauugguuugaccuuuaccuuggguuuguuugugcaggugaucaugauucugcucuucccuaucuccugccuccacauccccagcccuauccccaaauaauaugcuuuugggugcucuggcuucagcaggacaaacaguuauccuuuauuccccuuuagaacaaauuggggcagacuaaaucuuuaagacauuucacaaagugcuaagagaugacaagaaaauaaacaggaggugguacagagcauggacuccagaacuaggccacuuugguuugaauccagucucuuccauuuccuagcuucauaaccuuugcaagguacucaacaucucugugccucaguuuucuaaucuaaagaaugagaaugauaacaguacauauuucauaggguuguugugagaucuaaguagauuuaauaaaguucuuagaugagugccugacauauuuucagugcaauguaaguauuugcuauuaaauaagcacagaguacaaagaauugaaagaacaggauacagaaugguuaagagaauagauaguagagccagacuuccugaguucaaaacucugcgcugccauuugcuagcuguguaaccuuggcugaauuacuucaccccucuggccucaguuucaucagcuauaaaaguuggaaaaucauacuaauucauaagugugaggauuuaaagggucaauacauguauuuuguaaguacuuaauaauuaacagccauuauuauuagcugugugacuuuucaauguggcauucugaucacuagaggucacagaugcuguuccauuuuauaccugauacagaggaaaaagaggccucccccuggguucuggcacgcccucaugguaggugcagcuucauucaugugcucaccucuucacagucaggaacaggaugaagggacuguccuuucuuucaccuagcuaagcugcucagauuuccuuuuugagaccuacccuuuucugugauaacuguaugugaaccucucaaaucaacuagggggagcuuucuuguauuauagaaaccauuuuaauguaaucaacugaggcuagcauucauguaacaaaauuugaucacugcaaaaaugaagauaauauaguaauuggggagaggaagugagaagggaacugcguucuagaaauguauguguuauagcucuaaaaaucccuucucuaaaagcagagaaagccaacuccacauauaaaaggguaagguuucuguggcaaagagcuggggguuucuugagucagggagaguguaccugaggggaaggaaauaaccgcuguggcuagauucuauacccaauuguguuuguccagagcuaucauuucuucacuaaugccuacaggguggauggcagguagugcuggccugacuugaccugugaccagacaaacauucugccacuggcgcagguaaggguaguuaaaaaaaaagucucauuaaguagauaaagaacuacccuuauaucccaaucauuuggaugcuucagcuuccagaggccuugcaaucagcggaauccauauaaaaagauacuuuaaauagugauuuccucaaaauaacaaucuauaaaacauauauaguauauuucuuuuuaccauaaaagaaaauuagauuaucagaaauagagguuauaaaucauauguaauaugucugaacuuuuuauguaccauaauaacuaaucacuuggcuaucagggcacuggggaaauuacaguaaauuauauuuugugggauaugcacuacaugaaugaagccaagaauauuauacaagugaccuucaccuugugugaugugauagaaaaaaaugaugcuguccuaauaacuucauaggguuaauuaguuuuggaaaacacacaagaggcagcgaugucacagagcuuuuuuauuuucuuucccgugggaaguuggacuaauaaaaaugaaaaacauuucaaguagcuaaguaagaaagaagaguugcauagaguuagaacgccuaguucgcuuucucuguaagcugcaaaucuuauucuuuuuuugugcaucuuuucccauugacuugggaaucuuugaaauagccauuguuucuaaaaccugcucugacgauugauuuuuuaauucacugaugaacaugaaucuauuuaaucagauagggaacugugcagauagggagacauuuaucuguauaaaauaugcagcuuuguuuggucucuccacuuggauccccaguggggguggagguaaaguuuccacagucaugcugauuucagaugaauagguuugcuggugucaaagacaggcugcagcacuccgcuggcaucugggguacagaaggcuaauucuucugaauagagccauugaugauuacauuuuggagaaacuuaaucauagaguaauuaggcuuuaauucuuacaaaaacuuacaauuaauuggaucuuuuauacaacuuuuuuuguuugauuuaaaguaccauguagguuaguuauagaaacuuaauuuaaauauggauuuaauuagaauuguuuuaugauuuuaaugaauccuaaaagucuuuugaugagcagccuguauaauuauggcauuuaaaaugauuggguaaaugcauacuuuuauaauuuaccuuucaggaaacuguauuuuuauggagacuauuuucugcaugaugaauuguuucauuuuguguucaguuuuugugaguaugggugcuuaguccugccccuaaucacccaaauguuuucucucuagaaugaaauuaaacauucauggaaucaaaagcaucaggauguagccaaauacuacagcuaaauuuaaucacaggaauauuuuuguuuuuauuauaaaugagaaugaaucacugcuaaaacuuuuagcugguaauacaauuuuucuacauaaugagguaccuacaaguuaccugaugacaagcuccuuuucuauagaaaaaauaugugauuuuaagcaaaugauuugaauucauuuaauggaauuuaauauugaguugucaacuuuguaacauaaugucaaagcaaaaaugaguacuuucaauaaacaugaaaaauuuaaaaaucagaaaagaaagaaaaacauuagauaauaucuccucuuugaacagaccccauuccuacccauacuaacucagaugucuagcauuugguguuuuucugcugauuuuuuuaaaagggugcguuaaguaaguaauauuaagacacauguuuuuauuuuccauuuuuaaugauacuauuaucauuaaauguucuauccuucacuuugcaguuuagguucaauuauuuacauguuccuggaacacaaacagccaauucaauucaccauaucaaaauaguauaggagaaaaaaaaauguagucauugcaauagauguagaaaaauguuugacaaaacaauuccauaauaaaaacucaguaaacuaggaacaaaggagaacauaccaacuugauuaggggcaccuaugaaagaccuacagcuaauaccauacucaaagaucaguaauaaggcaaggauugucuucucccaaacucuuuuaaacaucguauuagacaaaaaaaaaaaaaaaaaaaaaaauagcugggcgugguggcgggcgccuguagucccaccuacucaggaggcugaggcaggagaauggcgugaauccaggagaaggagcuugcagugagccaagauagugccacugcacuccagccugggcgacagagcgagacuccgucucaaaacaaacaaacaaacaaacaaacaaaaaacaucguauuagauauuuuggccagugcaauaagacaagcaaagaaaacagaaagcaugcgaauaagaaagggagaaguaaagauguccuucuuugcaaaugacgugaucggcuagguagaaaaucauaaggaauccacaaaaaagguauuaaaucuaaugaauaaauuuagcaagauugcaggauacaaagucaauauaaaaacugguauuucuauauguuagcaaaaaaacaguuaauaauaaaaauuuuuaaacuucaauuucaaauagcauaaaaauauucaagaauaaaaauaacaaaagauaugcaagacgcgaacacuuaagucuauauaacauugcaaaaggaaaguaaaacauugcaaaaaaaguaaaagguaaaauaaguaaauaaaugggggaauaaauucauguuaaugaauugaagauucaauauuuuuagaugacagucuuccccaaauugaucuauaaauuccacaaaaucccaauuaaaauucaaacaagauuauuuggcaagauaauuuuuaaauuuauauuaaaaaguaaaggauucagaaugaccaaacaauuuugaaaagggaggaugaauuuggagggguuacauuaccugauuuaaagacuuccuauaaagcuaccuuaaucaagacaguguagaacugacuaaagaauggacuuuuucauaggaaaaugaaucuuaauaaagagucuagaaauagauccaugcuuauauggucaauuuauuuuugacaaaagugcuaaguuauuucaauggaggaaaaaaacagucuuuucaauaagugauacuggaacaacuggauauuuacauaaggaaacauaugagcuuuuauccuuauuucacagcuuuucacaaagauuaacuuaaaaugaauuuuagauauaaauaugaagaccuaaacuacucaacuucugaagaaaacauaggaaagaaaaucuuuaugacacuagguuaggcaaagauuucuuaaacuugacacaaaagacaaaaacugugaaaagagaaaugaaguuaaaauggacucucauuaagauuaaaaacuuuuuucuuccaaaagacauacuuaagaaaacaaagaggcaugccaagacuagaaggaauuuuuuauagacgauucuugacaaaaggcucgaauccaacauguauaaagaacucuuacaacucaaugggaaaacucaauuucauaaauagggaaauacuuaagcacacacuuuucaaaagauaauauacaaauggccaacgagcacagguaaagauacucaacauugauaguuaucucagggaaacguaaauuacuaccaguguaagguacuacuacauaccuacuguagaauggcuaaaaguuaaaagacugccaauaauaaguguugacaaagauguaaaguaauugaaacuuucauacaguguuggugggaauaaaaaauggaacagccacuuuagaaaucaaucugacaguacauuaugaagaguuaaauauauuuuuuccauagaacacaggaauuccccucccagcuauuuuauucaaguaaaaauacauguccaugcaaagaugagguugcaaauguuuauagcagcauuauacauaacaaccaaagugggaagcaacccaaauguccaucaacuguugaacgaauaaacaauggugauauaucucuacuaucaaauauuacucagcaauaaaaauaacaaaauaugaauaacucaaaaaugugaacgaaucucaaaaacaugcuaagugaaaggaccaaagacaaaagacuauguacuacaugaucccauuaauaugaaauucuagaaaaagcaaaacuauaaugacagaaagcauagccgaacugggaaauguuacugagugcaaagagguaugagaaaacuuauuuuuacuaacagguauuaaagagcuaucaguauggcauaagaaagaacuuucucacaauuaaauaugaagucuucaucaaauagagagguccaaauacuuacaaauuacaauaaaugccucaaaguaucaacacuuuauaaaauauguuacaguguucugucuuauuuucugguguacugucuuaauucagacgauuguaacagaauaccauagacugguuggcucaaacaacaaacauuuauuucuccucuggaggcugggagucacgaucagggugcuagccuggccagguucuggggagaguccucuucuggguuguagacagccaacuucucauugugaucuccucccaugguggaaagaggaugagaaaucucucuggggucucuuuuauaagggcauuaaucaaauucaugagagcaauacuuuugugaccuaaucgucuuugaaaguucccaccuucuaauaccaucauacuggcugucaggauuucaacauaugaauuuuggaggaauacaaacauccaguccauugcauguacauugugcuccauuuguuuucuuugacaguugaggcuguuguguuaacuuaagaguuacuaucauuucugaaguuuaaucauugcugacaauauuaccaguucagaauuugagggaguuuaggccuuggaauuuguuuuuuaaaaaauaacucccggucuggcgcgguggcucaugccuguaaucccagcacuuugggaggccgaggugggcggaucgcgaggucaggagaucaagaccauccuggcuaacacggagaaaccccgucucuacuaaaaauacaaaaauuagccagacgugguggcgggugccaguagucccagcuacucaggagacugaggcaggagaauggaaugaacccgggaggcggagcuugcaguaaaccgagaucucgcuacugcacuccagccugggcgacagagugagacuccaucucaaaacaaaacaaaaaaaaauuaaaaaaaaaaaaaaaaaaaaacuccuuucucucagauuucuguuuuucaucuuuuuuuuuuuuuccuucccuccaaugaacuccugcuuccaccaucccuaauuucacaacaguucugccugucugaaucugaacuggcuaaaaaaugcuaguuuucuuugccacuuuucuucaagccaucuaaucagaauuuucagauuuaccuuuucuucuuccuacucaacaacucccuagcccccagccccagucuuaguccuuaugaugugccugcauggauuauuuuagcagcguccuuguucccagucuuucucaauuccgauccaccuuugcacuguauuucagugucaaacuugccuuuauucacuaucaauuucaggaguuuauucuucggcucaagaacuugcaguaauuuucuauuauaugauccaucaagucugaacuauucccaauaggcuuuuaaguccaucugcaaauggcucuacuacaugacuucugaucccuuuguuguucuauacacacuggccccucucugccucuggaauauaugugcccacccucaugucuucccuuggguuuuggucaucuuuucucuacccaaacugaaggcauccuucaacuccuacuucccucacaacacccucucugguagcuccugcucuuaccaaacuauguccuuucucaguuucuaaugaaugaacaaugcuuugaucucaguagcuccuucguguguauacaugauuggucuaucucugagcaggauuaugugcuuccuaaaggcagagaccagaucuuauauuggauuuguuuacucaaaaugucaaauacaacacaagacauauaguacauaauauuacuaacuuugccauguacuuuucaccauauauuugcuuauuugcuuuacaucauaaauaaccuaauuaagcaccuacaaauugacuuauuuauuaucacauaucccuugcuuaugucauuuguuguccuacaauucucuuuuuaccucuuuacuucuuccaaauggaaauauuauuuacugcuuuagaaaggucaguaaauauuggcauuuguacaccaauaaucaaaaucaucuauacuauccuauauaaauuuaugaacaauccuaaccauuaaagauuauguggaguuuuuaaaaaauuaaaaauaaacuaaacuuauaugcaaauaaaauacucacaauuccuuaacuacaauucugaaauacacauaacucuuaaacuaaaagucuuuucuuauaaguugauagucuuaauuuauuccaccuaaaaugaauguuuauauguuuugcugcagauauauuaauguguuugguuguauaguacuacccuauacucuguugggaagguuacuuuaaauaaacagaaaaugcauuguauuaccuuuccaaagucugaguuuugaaaaugaccucaaugguuucagguaagggaauuguguaauacauuuguauagugcugugcagaccuuugcuuaaucaucucaguuaaugcuccaaauaauguuaugguagcuauuauuaauauuuccauuuucuauacuagaaaacuaagaugcaaagaaauuauguaacuugcuaguaaaugauacaacugaagcucauauuuucuaauuuuaaaaucuaugcccuuuuuuucugugccaauaucuugaacagaugguuugaaucucuacucuuuaagaaucauaauaaacuggaacuaggaauuuuuauauauccugaccuaucuauguguauccagaacauguacuccauacauuaugaacuggcaagccugcuguggugaauggagagcuuguugaguacaauugcugaaauaagaccagagugcagggguaauucuuccagggucuuauaauuugagaaaaacuuaaaauaaggaaaggucagcauuuaauucaguagcuacagguaaaaccuguaguggguaucuaaaaacaagugggaugaauacaaauauuuaauauguggcuuccuuauaaagucaaagaagcacuuaaaucaaugcauauaccucucaaccauacaccauauucuuuugauaaguaggcaucaauaaucuucagcauacucaaggcucuaugugguuaauuacaguauguccucagcccuagaaguauaugaaauauaauucaaagugugucauaaagaugccuagagcaguagauuguuauagugaugacuuccaauaaauuacaagucccaggaucccauacugacucugggcuugguccugugacuugcuuuggccaagggacaucagcaaacaugaugagaguagaaacuggugcauuggggcugcccuuuagaaaaccaucaugcugugaagaagacugacaugaaagacaauacccgcagagagccccagccugauuagaugagcuaucagauugguaagucuaggcaagacaagcagagcuucccagagaauugugagaaauaguugauuguauuguuuuaauucacuaaguuuugggguggcuuguuauacaauagauaacuggauacacccagcugccaguuuuucauaaggggaaaugacuucagccugaguuguggauucuucauugacaaaguacagaagguacaaacuuaagaugaaaugauaaauuuaaauagauaccaaagacugaguuuccucugaucuuugcauuuaaacccuaauauuuuuuaaagacuuguguauguguguguauauguguauauauaaauauaugcauuuucauaaguuuaaucuucuuuaaaauaauuuacaugauaauagcacaaaaccugugcauaaguuucuuaaauauuugcaucuauaaaguauaggagguuuuguugaauauagacaagauagagucuaugccuucuuuuuagacuaagaacaaaaagcagauaaaacauucuaauauaaagaguaugaggucuguguuugugugaaugaucaauguguuuaaaagcagaaaagaaaccauaaauggacagcaaguagguuggccuuuucagagugagaaugcauguaugaaaauggcaaaagaacugcuggagucuuaagaguucuugcauuccaauguaaaauguaaaaauggggauaauaauauuuacacugaauaguuguuucagaaauaaaugagauaauaaauauggaagggaaaauauagcaccugauagucauauuucuuucuuccaugcuaccucacuuccuuucauccuuaacaucucuaggaaaaucguuucucuacucgcgacacuuagaauacuaaauguuuggguucuccacagcaugcaguucuccaguucucuguagacaccaacugcauguccuacuauuaaauuuaacucugauaccaacuacccggaguuagugcaguccccacagguuaaaggcucaguccuacaagauugccccucauuuuggaugccaaucacaaguggugggucuccagguuaaccacauuucugacuuggcuacaaaucugggguucccacaacucauucagguuugauaauuugcuauaauggcucauaaaacucagggaaacacuuaaguuuauuguuuauuauaaaggauauuauaaagguuuauuauaaaggauauuauaaaggauagaaauacacagccagaugaagagguacauaggcugagguccagaaugguccugccugagcacaaaagcuucugcagaguagagaugugccacccuccuggcauguggauguguucacuaacccagaagcucccacacucugucauuuaggauuuuuauagagguuucaucacauaagcaugauugauuaaaucauuggccauuggcucaauuuccagcccuuuucuccuucugggaugucaagggguugggcugaaagucucaacccucuaaucaugccuugaucuuucugagaaccagccccauccuaaaguuacucagggaccccagccaguagucaucucauuagcauauaaaaugacacucuuaucacugggucuuagaagcucuuuuaucaggaaccagagacuaagaccagaacaaaagauuuauaacaaaacaugcuccuauuaucccuaucacuuuggaaauuacaaggguuuuaggagcucugugucaggaacuggggcagagaccaaauauacaucucuucuuaugucacaaaauucauaacagauuuuaguucauuuugauucuuaagaguugucaugguuuuguauaucaauuauuuuugguguagcagguaggugauaauuuguauuuaauacuuuuagcugaaugaugaggaauaguguaaagagugaauccuuuacaaaugaauccuuuccaaaggauucauuucuggcuguacagaauuuuuuugguaguuugaccuugaaucagaaagaaacaaaaacaaaacccacaaacucucuuccuugcucuucugugcuaagauauacacaaccucuugggacagaacaggcuaggaggugagcuacaagaaaaaccauaauuacuaagaaccuguucccuaccuuacuagagauaccacugugcaaacugccuaucuauucauuuaguccucaaauauuugcugagcagaaucaccaaauaauucacuagguucugaaguuauugagauaauagauucaguccugccaucaaaaagagaggggacaacacaguagggggacacagaaguuuaaaaaauaacugcaaauaaucucucaagguaugcaauauuagaaguaaauaaucacauaccucuguauuuucauaaaggaaaaaaauuaucauaaaaguauuucaaaaauaucaguacuugcuuaggggaagaaggaggcgagacuggagauggagaguggauagaaaacuuggcauaagaagggacauuuacggcugggcaugguggcuuucaccuguaauccuaccacuuuggaagggcgaggcagguggaucaccugaggucagaaauucgaaaccagccuggccaacauggugaaaccccaucucuacuaaaaauacaaaaaguagccuggugugguggcaugugccuguaaucccagcuacccaggaggcugaggcaggagaaucucuggaacccaggaggcggaggcuucagugagccaagaucaugccacugcacuccagcccuggugacagagaaaggcccugucucaaaaaaaaaaaaaaaaaaaaaaaaaaagaagggacauuuuaaguuaugucuugaaagaugaauaauucacaggaaauaaucagcucuuccuugguaugaacagcugaagggugaagugagccugcauugucuauagggugcgcugaaggucccacugaaggguaggaugggagaagaaugguagaagagggagcuggauaugcgagcaggaaccaagucagaaagagguuuguauauguugauaaggaguuuaaacaucuugucagcaguaguaagucacuaaugaagagucauuaaagagauccaaccaggguuuagacugcagggacaaaggcaguuuccugcagcugguguccagaaggcagagagaggagagaagcuaaguuaaaccuaaccugaagacauaauuuaucccacacuaaguauccuuugaauuaaaugaaaaccuuuaaacucucuuaggauuuuuccauccucagccauaguuaaacuaugaaaucgaugaaucaaaauuucaauugcuguuuuacucuucucuguggacuaaguuuuuagaauaugcuguuuauucucuuuaccuugauguaguccuguucucuccuagcuauccucccggcuggaugugccauggcaugucuuacagcaguaauacauuacguuaauaaagcaauuauuuaauugacucuaauuucauuggcauuccuauuagcuaaaggaaagugguucaaucacuguuuacauuuguaaagccaauauuaugguuuaaauuauggucuuuggaugaauuugaaaauugaagccugauaauccuuaaagcaauauuuacagaggauucuuuguaaagaauaaagggaauggaaacaagagcacauuaaaucagaggggcuuuuaaauauucauuuugcaaucagcuucacugguuuccagaccacuaccuaacuuuguaauucuuguuguagaggaauaccaaaucucuugcuuuaauuauccugugaaauaugaacugcuacuucacauucucuuuucugauucuaaaguauaggaguuccagauauaaugcucacaaugcaaaugcucuuccuuaauggaaauaccuugggagacauugcuaaaauuaguauuucaaaaauguagacauuuuggauaggguagcuucugauuuaaaaugacuucugcucagcagcuguuaauaaaucucuuuaaauuacccaguaaaauaaccaugagaguacuaaaaaugguaaaaacucacaacucugaaaacaguguaucaguaaaccuguugucagugguuuuccaugaaccacaagugguggaaguggucuaaauagcaguguccuacuuugaagaugaauaacccagagagcccaaauaaugguuggccaaauaugcugcagccuaaaagaaaguaaaaucacucugaaaaaaauaaaaaccacugaaacauguuuaauauggggaccagacaaaaauauuugaguacucugugacacugaaaaaaaguauguaagacuuaguuaauuucaagaaagaugaaaauagauuuaaaguuuucaggcagauaaaaaauaaagcagguuaccuaaaaagggacaaaaauuaggcugaccuuaaacuucucugaaacaugaaaugccauaggaugaugguuucauaucuauagcauuuuuagcaaaaauaguauguagauucccaaauacccuucagccaaaguccccuuauguuaacaucuuauguaaccaaagaauauuuaucaaaacuaagaaauuaaccuugguuguagguaauucuguuaacuaaaguacagaacuuuuucagauaucaccaauuuucuauuaucauccuuuuguuuuccaaaaucucacauuacauuuaguugucauaucucuaguugcuuccaaucuacgacagcacaggagucuuuguuuuucaugaucuugacacuuuugaaggauacugguaaauuauuuuguagaaugugccucaauuuugguuuguaagaugguuucucgugauuggauuaaaguuauguguuauugagggggaaaccacagagaugaugcacccuugucaguuuauuguaucagggaucacauaauguccauuugucuaauuacuggugauguuacccuugaucauuugguugagcuuguauuuuuuaggauucuccacuguaaaguuauuauuuuucuuuuauaauuacuaaguacuuugggggagaugcuuugauauuauaaaaauauccuauuuuugcauaaacuuuuacccacuaauuuugcauccauuguguggcaauuguuaccgugugguguuuuaaugaugauuucuauuuccuuuauuccuuguauuuauuaauugugauuauuauauaagaaagaauugucacuucuccccaauuuacucaguuauuauuuauauuaguauggauucauguauauuuauuuuauuauuugguuauaauccaaugcuaucauuacuuuguugcacaaguuguucaacuuuggcaauugguaacuuuuccuggguggcuccuaucuguuuuaauaugcucccaucguuuuuucuuuuccuuuacuuccuuacuuucagaugcuccaggcucauauuguauuaucccuucuccagcaccuagaaucagcuauuucuccagauauuccuguuucuuuuauuggagaaggaauuuagaaaccaagaucuguguucacugcuacugggguagcuucuagccucuuucagugacuagagugaggaaauauaugugugguuacuaacuaaugcauacacacacaucaaaaccaaacaguguuuaugcacaguucuuuuguucuucagccuuaaaguauccagucaaaacacuucuuuccagaguuuuguaagucagcucccuuuucccccauucccuucaauguugcuuugugauuuaauuguaauauaguuagauuccuugucacagucugcauucuaucuuuuccuccaaauccugguugauuugucgguuguuuuccuacaaaaaaguucacucuguguguguacaguucuauguguuuugacaacuguguagagucacauguccaccacugccuucucugcagagcaauuucaucacucuccaaaaguaugaguuacccuuuuuuggacaaucucuccucucauucucaaccccuggcaaccaaagaucuguuuuccugccuaugcuuuugcuuuguuaagaauaucauguaaaaugaauucacauaauauguagccauuugauucugucuucuuucacuuagaaaaauguauuuuaaauuaauucauguuguauaaaucaauaguuuguucccuuuuagggcugaauggcauaucauugauaugaaaucacuuaaggauaucuggauugucuacaauuucugguuauugugaauaaagcucuuauaaacauucacauauuuuuaugugaauauaaauuuccauuucuuuuagguacauagcuaggaguaggauaacugggugauaugguagguguauauuuaacuuuuuaauacauggccaaaacauguccaaaaguggcuacacuauuuugcauucccaccugucuauagcauuguaaggagaaaauugguagccuaagaauuuuaugcccucuuaaauguuguuugugugugauggcagcagaauucucaguuauucaauaauucaaaauuuauaucaccaaacauccuucuugaaaaaaauuauuuaaagucauacuguagcuaguugagagagaaaucaaaauuaagaagucaaaagaacccauuucuaagaaaaucuuaaggggaaaaaaugaagaaggagacuuccuucucauaaaaaaggauaccuaagaagacagaucacaucauauaauauuaauaguaaagccagaacucucauuaaaaucaaggggggacagaauucccaaucuccuccuuauuuaacuguauucuaaaauuucugguuagugcaauaagacacaaaucagaaauaacugauagaaaggacuaacugauggacaggaaaagagaaaaaagguuaguaauugcagagaauguuucuuagaaaacccaaaaaugccaagucaaauccucuuaaauauaaauuaguaaggcuauggaauacuagaaaaauaccaaaaaauaucaauaucccagcaagaaacagaggagaugauaggaaaaucuuauaugaauaacagcaacauacacaccauaaaauuucuaggaauaacccuaacuaaaauaugcaggaucagaaaacuguaaaucuuauugaaauauggaagacuuggauacugacuuuuacaauacugccauuuauuaauucauucauuugauuacuuguccaaaauuugucuuugccacugguauacguuccauaagagaagggacaguaauugucauauuuacugucuuaucccuuaugccuaauauauuggcugacucauaguaggaacucaaaaauauguauuucuacacacuaauauuuuauucaguuaucuguucuacaauguuuuaauagcuuauaagacuuacucacuuaguagcuuaguaguuuuugaaaggagucuagacuaguuaauuaccauugccuaacaaauuauaauacgcagccauucaaccacaggcagcauuaaggcuccugguuugaaguguagauacccacaguccugcauuaugauuuuucuucacuuucccacuccaauauuaauacauuccacaacaguaggaauuucaaagcuuagaggaauuuaggggguuuuagaaguggcuguucucuaugaaaagugugauuuuacuuccucauuucaauuuuuagaucucucaggaaaugccagguuaguagcaaaugaaugggaauggacuacaaauuauaguuauuaaaaaaagaagaacccauaaaagacccacagaaucuaggagcagguuaaaaugaacuauuugacaguaugcaaucugagucacuuaucuggaaucuuucugcuuccauguaauauagaauuuaaaguuaaugaugcuucccaggauuccauugcucaauggcuuaguuucauuuuauaauuagguuaacauuuuucuuuauaauauuugauuggugacauuuuucuagauuuuaaaaauaaugaaaugauauuguaacauugguuaaaguugaccuaauaucuaaaccacagcugaauuuuccacauaaagcauuuucuugauuauuccuaucauuuuccaauguuuuauuaucuguggugugcauugguguuuuuguguguuugcucgggguggggauacuguguaguaauuucccuguugugcuuuuaaauaggaacuuucuaggaacacuagcaaugguaaugucauaguuacuuacugagagaacuaaccugaauucuauggagguauacugaaguuuugggaaaaugaaauuagagaugcagcauaucucagcaguaaugaaucuguuucuguuguauaaaacaggguuagguuguucuucuuaaaagcaguuuuucaaacuugguacuuuuuacuggucaaguguuuauuccauugggucauuaaucuguuauauucccaaaguacucuuuggguauaguuccuguucuagcuaaugugaaagaagcauuggucuauggcagauuuuuuuuaugcuuuuuaaugauaauuuugaauuguuuagguaagacccucuugaguaucuccuagugcuuauaaaugaaaagagcuaguaaagaccuuguuuauaaugacugacuuuacaacaaaguugggcauauuaaucaacaauagacacugucaguucuauugcauauuacuagacugaugggggugucuccaccuguuuucuguuguuacaacagaauaccugagccuggguaauuuacaaagaaaagagguuucuuuaguucauaauucuucuugcuagaagguuuaagauugggcagcuacauccagugagggccucaugcugcuuccacucauagcagaaaguggauacaugcaaagagaucacauggugagagagcaagcaagagagagaaaccagggaggccaggcucuuuuuuaaaaaccugcucuugugggaaguaauccauucuaaugagagugagaacucacccuugcaagagagcauuaaucuauuucuugagggaucugcccccaugacccaaacaccucucaacaggcccuacccccaacacugccacauuggggaucaaauuucaacaugggucuuggcaggagcaaaccacagcaaggggauuuagcaauaaaaaaauuuaauaaauuugauacggaauucagaauuguaauacaguagcagaaacacaucauaaaaauuuagacaucaaugaggauaaccuuugaaugucaacugcuuauaaaugaauuagacuugcugcauuuuggcuaaauuuauagguuauggcaaauaagaugggagggggcaagacagaagaaacuagaaugauuuuguuuacuaaauaucucaaugucaacuguuauuuuuaaugcuuccuagauauuucccuaaaaauaugaaauuuauucaaccuaaauucacguaaauauagaaggaaauucuuuaacuugaucaauuaaugaacuucuuuuggaaauuaauuuuaacauuagucaacuguuacauuugaaguuagaauuuaaauaagggagagaaacuuagaacaggagaauacaggggaaugcuguaaggcuguguaggugagaaagaaggcucuccaaagucauaaggccuucuuccaagauacugaguaguugugcuggauuauucucuugggagucauagaaagagguaacacaguacuugacuuucucugaugccaaaaagcucuggaacugucagucagaauuuucuguauaugacaauaacuguggugcacucacugcaaaaauaaaacauuauuagacguaaucacaccuuuagcugugaugacagauguuaaaaugacuauaagcaguuaaaggggaaacaggucacagacaguuaucuggaagcaaugagacaaggauguuugaagaaauaaccuauuaucuggagaaugauaggauuuuaggauaugagagauaaugggugagcuaauugggaagacaaaacagcaggccaauuucuaauuaaauugacagcauauguaggauuucauucagggaaaguaccagugaucugagaugggccaccauuugcuccaugcaauucugcaaugagagugcugcuggaagaugccucauaaagaagggcuagaaacauggcauagcuuuuaggggcaagacuuuuuuucacugccuaucaagauaaauaccauaccaaugauguguucauccacaauaugguaaugaaauaggaagagggcauccagggugauagcugugagagugagucaguguauaaauucugcuuaggaaggaagauguuuaaauuugaaaaaaaauccauaaguauuaaaggguauucuugcugccuuccuauugugacacucaucugacuaaaagauaaaucaaacggaauggacugauaggguugguaacuggaugugguaggaagaaagcugaauaaauuagcaaaggacagaguuuuuuuuauuuaaaaggguuauaguuuucagauguuguuugaccucuuaaagggggauaagcuugauauuuuuaaagcaauacuuacaucugaaauaguaucacguacauuuuuagcuaguacucaaacaaguuccauauucuauauaaauggggaaauguaauucauaauugacaagguaugaauuuuuuacacuuuaagccaugagauugccacaucaacaaauguaauuccuuagcaaauaugucuuauguuuauauuuaugaaauguacacaauugacgcagaacccaaaagggaauaaguaagcauuuuaaauauauauauauauuuacuuggauuugcaaacuccguucuggaaaacauuuauuaaaugagaaacaaggaaggaaugcaagcaaaaugugcuuagagucucaauuuaucuuggacuugguguuacuuuucuggauuuuuccaaagcuuagacuuccauugguuaaaguguuggccuuugcuuuguuuuguuuuuguuuuuaacuuacagaguacuagucucaaaaguggaaaugauaaacuauuaaaacuucaaauuuaucuaugggagccccacagugcaguggugauuucauguuaaauauuuuaaguugaaacagcaagaaagagaucaagcgaaguaucuuagaaagagagacaaggucuggauacgugauguauuccacauuucaugcagcuauugaaaagggcaacacagcuugccuaagggccauaaaaugaguacaguuggagaguccaggcuccagaaugaaaacuagcagguugugaugauuuguagagguguguauguaagcauguccaggaagcucuauguugcuuucccuguucugaggcuugcccugcccacauaagggucucuacuucacuucucuaagugugguggauuguauuuucuaaagaugauggcagcaguacaccuacccacccauauacuauuuuaaaaccuugccaugcccccaucaagagguggagccucguuuuccuccccuugaaucugagagcugaugacuccuuuguaaccaauagaauacuauagaagugguacuauaugaauuucaaggcuggaccauaaaaagcagugcagcuucugaacugagacacugcucuuggaacacugagcuguuaggucagaaguccaaacaacggggagcugccauguuaugaggaagcccaggccauauggaaagacuaaguguagauucuccuggugaccauguuagcugagggucccucagauagccaacaucacccacuagauaugugaauaaagaugccucagaugagugucucccaaucuuugaaucucuuucagacauccuggaguagagacaaacucuucccacugugaccuuuccaauggcuuuauugugcaauaguaacuguaacauuaagagaaguauuaagcagaaacccugagaagacagccaggcaucuuuucucacucccuaguuuccuaugguauuugcccugguaacagcaucuuuucucacucccuaguuuccuaugguauuugcccugguaacagaaagagcaugauauagaagugucgcuaauugucucacacuugcuuaaucuauuuuuauaaauuaaaauaguuauuuucuguaaauuauucaauaauuuaacuuuauuacuaaaaauaauagcuucauaucuagaaagcaagguauuaugagggacaguaaaauaccaacccugauuuaugagguaucucucaugugccaagcacacugccaaaucuuuuccuaaauuaccuuaaucuucacaauaaccuuacaaauuagguauuaugauccuuauuugaagaugaaaaaacugaggccaauaugagguuaauuuacauuacucaagaucagcauagugaaucuaaccuggcucuaaaauuucauacaccuucuaccacauugcauuugagcaacgaaaagcagaccguaaguauaguagguccauagauguuaguucaaagccaaaaaaaaaaucaugagucaaacaaaauucuagaaacaaucauuuaccuaaauauugauaagccuucuaacuuaaagaagcuugcucucuauauauugccagacaaaacugugggucauuuugacuacaaacauaugagauacugugagccagaacuaaccaacuaagucacucaaaaacugugugaaucaauaaauguuuauuguuuuaagcugcugaguauuuaggggauaaucuguuaagcaguaaugaauaacuaauacuuagucuaugagaucucucugcagucaaucuguauguagccagucaauagcucugcauucugaaguuacacuauauaagcaacuauccauacauuuugcaaaacugauaguucugacccuaagcccuggggccaucagucuauuauagcagcuaguaugacaugguuauaaugaauuucagacaaguaaucaaggguccugaguucaaguccaagauugaccagugacaaacuguacucucugggcaucaguuucuguaaaauggaggaguacacagaagaucucuaauacuuuuuccacucuaauuuacuuuaauucuauaauuguuaucuucauauaauuauuuccaucuguuuuauuauuauaugucuuuuaacucuaaagcaaaauauuuccccaacgucugagaaucucaugucacuaucuucagcguggaauccuaaugagacauucaauguucaaauacauugaggcgcauuaucauguaucuuuuuuguuuuuuucucugcauauacuaggaugucuuaaggauccuucuguuuuaucugcacucucucaguaucuucuaccaaaaaagggggauaagugcauuucuuucacuuauuuucauuggcuacaguaaaucaucacauugccacuaccaccuucaagggaacaggaaagaguccagaaagaagagaauuacaauaauggcaaacaaucuuaauuaaacaaucuuaauuauggagguauuaauuaaauaccuccauaauuaguaaaauacaugcaugggucaagaaaguuuuuaaagcuagauuuuguuuugaaaaaaaguuaauucugcugacauuuuccugaagaugggucauucacuuaacaaauauuuauuggguaccuauuacuugccaaacaauguuccaggcacuaaggacaaugugguaaacaugauaaacaaggucucuacccucauacaacuuacauucaaguugauaucaaaguuauuuuacaaaaauucaaaggcauuugcacucuguauuagucuguuuccacacagcugauaaagacauacccgagacugggaagaaaaagagguuuaauggacuuacaguuccacaaggcuggggaggccucacaaucaugguggaaggagcaagucacgucuuacaaggauggcggcaggcaaaagaagagcuuguacagggaaccuccuguuuuuaaaaccaucugaccuugugugagacucauucacuaucaugagaacagcauaggaaagaccugcacccauaauucaaucaccucccaccaaguuccucccaugacaugugggaauugugggaguuacaauucaagaugagauuuggguggggacacagcaaaccauaucacacuccuaucaaaauuucaguccacugauguuggugcugguucugaaugauucagagggauuuuuggcuccuuaggccacucuuuuuguguaauuuaaugcuucuguuuaccaaaucauuugaccuuucugacccaucaaaacauagugagaugaaagcaugucauauuccaugaaugaugugaugagcacacauuccauguaaaauucaguucuuuuguucaagagugcucuucucccaauuccuuggggcugguaugauaggcagaaagaucacuuugugauccagggccuguuuugugacauuggaaguuacuuacuucucuaagccucagcuccccauaaucccccaacauuguaguguuuuguaagcuuugaaugaagcuuucauuuucauuuuguuccagcuuucuuccuuuuggccuaucuugggaauaguuacagucuauauguacagcagacugucagccuucuagccacauuaccugccuacuugaugccacugagccagacuugccucucaaccuccuugaugcagcaugaacuuggagaaagcaguacuucucguuaguucccccaggaguaaggaaaggaauaaaagaaugggucucaucauccccaaguagcaaaaaugauaauaaguauuuugagacauuccuaaucugccaccacugugaaaguaauguuuucucaaguggaucugaaacuccaugagaguaguucauguuucacuauuguuuucguuuuguuuuguuuuguuuuguuuuguuuuuuugagauggagucuugcucugucgcccaggcugcagugcaguggcgugaucuuggcucacugcaagcucugucuccuggguucacgccauucuccugccucagccugcagaguagcugggacuacaggcacccgccaccaugccuggcuuauuuuuuguauuuuuaguagagacgggguuucaccguguuagccaggauggucuugaucuccugaccucgugaacugcccgccucgaccucccaaucacuauuguuauaugaaacauagagacuuagagagagauagcuuacgugggagauguacccuuauggguaagagcauuagcucuggauccaguugcuuggguuagaauccuggcugcaccacugaccagggacuuuggguaauuccuggucuguagcaauaauaauaguuaacccaucucauaaaauugugagggcuaaaugaauugauauaugcaaaguacucagaauagagccucaaagaaauugcaguugcuaaauaaguauuagcuguuauuacugauauuauuacaugcuccaaaccccuacagugcuccgaacauagucauucaguaaauaauugaauuccugaaagaaugaaaggaaugaacuuugggaucuuuaugaauaugaacauauaggcagugacucgaugaagaguaaaggcaccaucaaccauacaaaguugucauuuucuccugaauucuagaucuuuuuuuuuuuuuuuuuuucugucacccaggcuggacugcaguggcaccaccuuggcucacuguaaccucugccucccgggcucaagugauucucccgccucagccucccaaaaugcugggauuacaggcaugugccaccaugccccgcuaauuuuuguauuuucaguagagacaggguuucaccauguugcccagacuggucuugaacuccugaccucaggugauccaccugccucagccucccaaagugcugagauuacaggcaugaaccauugcacccugccaguuuuaaauuuuuuaacuucuuagucaauuucaaucaaaauaugagucaggccuauauuucaaauccuuuucuaaacacaauauuacuguuaguuggaaugacagaauuguaaacaggcucuuuagcuaauagacuguguguuucuaaaugauacuuuuauucagauucucauuuccagaagagguuagugcaugguuggccuugugacaacuguguugucuaaacaauugguuuugucuuuacacaggcuaguaaaaucacccucaauuuuugauaacuuuagauuuguaaauauguaauccuuuucuugaugaaaaaggaaauguuuuuaucauuuuuagagcaagagcaguauugcuugacacaguuuaaguaucuuuuaauguaacaguuaaauauauggaauaaacaccaagugucuauagagcauaguccaugaaaauuuccagauauaucaaguuuaacaggaaaaaaauacaccuuuucuuuugauucauuaaauuauaccuuacucugaagaaaaucagcaauaugguucuggcaguauauaguaguccugacacuucucuuaguaagggacauuuuucuaccucaccacuaaaugcuggacaaauaguaugaccuuggccuucuaucuaaacucuuaaaauuguuuaagauccacugguggaaaugaagucucuaaggagauguggaugauuuacugauaacagaaaagguucagauuccauuacuacugauggcugugcuuccguuuauguuuucccuaagccauaacuauuuaaaauguuacuguuagcauucuuauuugucucauuuguugguauauaacucuccuacuuaaauauauagaacaaaucauauuaauuaaaauaaauugcuuggacaguuaaguuguccugcagauugucuccgaaggcuauaaauucagauuaaggguuuuguugcuuguuccugagcuuggaaagauuccuuuuacugcauuaguaguagcucaagaaaucaacaaccuugcaaaagaacagucauuugaauucuugcagaaauagcuggauaaacugcauauauagcuaguuaucauaaucauauaacaaaaucuuggcuuaagcaagcaaacaaauuacuaauucaugauggcaaguguugauauauaauaguauugaguuuggacauaauuauauguauuucuauguauuuuaaaaauauacauuuauguauguuuauaucuauuauauuuauuucuauguauuucuauauauuuuauuauauauauauuaaauuggguuucggggguucuaaguaguguaccauaguagcaaauugugagauauuuuuguaaaauaaacaaauaaacuucauuuucuggauauuaaagcauucaauuaggucaaaauaaauuguggggagugggaauaacuuacucugccuauuucaagaaaagccuauguuuuguaacuucuaaaggcaaagaugugacuaccauuuauaguauucuauaaaaauuuaauguccuuugcauuucauggaaccucuguaauauuaaaaaagaauagcccaaucuaucauuaaauuugaaaauaaaguagaacaaauaaauuauauucuuaacuuuuauuugaccuuuuaguguggguauauuuccuuuuaccuacuuaaggaaaauuaacauuuuccuuuuuccuacuggaguuuccccaaaacuaauacaccuuaauuagcuugaggaaauaacuaaagugaaguagaaauaagguuguaaagaucucucugaucucuuagcaaagugagauuuuugccauccauuuauucccaaaagcugcuacugaaaacauguaaggccuuguaacucccuuauaaaaccccugcuauuuaacuacuuuagagauucaguacaaaguucagaggaaaacaaaacuauuaaaguguugaaaauuacaaccuauacagaaauuuuaaacaacucuauuuuugagaagauaaaucaacuuucgaguuaccuaaaaagaacaauguugauuucucaauuucugcuaacguaugcuaaaggggauggacugaaacuaugcauauuucuuaaaacauggguuuuaaaacauuaggcaaaagcuuuuguggauuuucaucauccggagaacguaucagaaagaggguaggucucauccgauuaccugucuucaagggaagaaacugacguuaauccuaugguuuuucuuggggugaggagggggguguaauggaguuacuaaaaaauugugccauuuaaauucaagaugaauauucugguuuguaauggauuucccacuacuauuccugaaucauaauacucauaacguuauucucaaauacaggauaguuuuauaucugucccuucucuaaggcuuuugcuuugggacuauagaacaucauauucuauaguuuccaaucuuaccauauaauuuaauaaugauuuuauuacucaaaaaaaguuauacugcuuucugucauuaauguugcugccuuuccaaugagucaagaaggacaugagcacuuugggaggcugaggcagguggaucaccugagguuaggaguucaagaccagccuggccaacauggugaaaccccgucucuacuaaaaauacaaaaauuagcugggcaugguggugcgugccuguaaucccagcuacucaggaggcugaggcaggagaauggcgugaacccgggaggcggaguuugcagugagccgagaucaugccacugcacuccagacugggugacagagcgagauuccaucucaaaaaaaaaaaaaaaaaaaaacaaccaagaggaaggacaugaauuauuuccuaaggcuacccccagauugcuucaugaggcaaggaagaaauaccugaauuacguauuuccugccaacaaauuacuaaaaugaagccuaagaaaacagcacugaugccuuuuauuaccacugacauuucauacuaaacugaaauacuguacacaaucuuuaaaggauuuugaauauggauuuagaauaauuauuuaguucaguccauauaaugaacgcucucugucugaaugaucucccugaggacaaaaccauauucagcucuucucacuacuguugccuagcacagugguuuuuuguuucguuuuguuuuauuuuguuuuuuaauuuuuguggcuacauagguguauauauuuaugggguacaugagauguuaugauacaggcauguaaugugaaauaagcacaucauggggaauugguauccauucccucaagcauuuauccuuugaguuacaaacaauccaauuacacucuuaguuauuuuaaaauguacaauuaagguuuuauaaacuauagucacaauauugugcuaucaaauaguaggucuuauucauuguuucuaacuaguuuuuguacccauuaacuauacccaccucacccucagccccucacuacucuucccagccucugguaaccaucuuucuacucucuauguccaugaguucaauuguuuugauuuuuagauaccacaaauaagugagaacaugugauguuugucuuuccgugccuggcuuauuucacuuaacauaaugaucuccaguuccauccgugcuguugcaaaugacaggaucucauucuuuuuuauggucaaauauuacuccauuguguauauguaccacauuuucuuuauccauuuaucuauuguuggacgcuuaaguugcuuccaaaucuuuguaagcagugcugcaaugaacauaggaguauagauaucucuuugauaugcugauuuccuuuccuuuggguauauacccagcagugggauugcuggaucauaugguagcucuauuuuuaguuuuuugaggaaccuccaacuguuuuccuuagggguuauauuaauuuacacccccacuaacaguguacaaggguucccuuuucucuauauccucgccagcauuuguuauugccugucuuugggauauaagccauuuuaacuggcaugagaugauaucucauuguaauuuugauuugcauuucucuaaugaucaaugaugcugagcaccuuuucauauaccuguuugccauugguaugucuuuugaaaaauuucuauucaaaucuuuuccaucuuuugaucagauuauuagacuuuuuuucuguagaguuguuugaacuccuuauauauucugauuauuaaucccuuuucagaagaguagugugcaaauauuuucucccauucuguggguugucucuuugcuuuguugauuguauccuuugcuguccagaagcuuuuuaacuuguuuugaucccauuugucaauuuucgcuuugguugccugugcuugugggguauuguucaagaaaucuuuagccagacuaauguccuggagauuuuccccaauguuuucuuguaguaguuucauagcuugaggucuuauauuuuaugucuuuaauccauuuugauuugauuuuuuuauauggcgagagaugggggucuaguuucauucuucuguauaugaauauccaguuuucccagcaccauuuauugaagagacugucuuuuccccagugcauguucuuagaaccuuuguuaaaaaugaguucacuaaggccgggcacguguggcucacaccuguaaucccagcacuuugggaggcugaggcaggcagaucacgaggucaggagaugaagaccauccuggcuaacacggugaaaccccaucucuacuaaaaauacaaaaaauuagccggacgugguggcacgcgucuguagucccagcuacucaggaaacuaaggcaggagaaucacuugaaccugggaggcagagguugcagugagccaagaucgcuccacugcacuccagccugggcaacagagugagacucugucuaaaaaaaaaaaaaaauaaguucacuguagguguguggauuguuucugaguucucuauucuguuccauuagucuaugugucuuuuuuaugcuaauaccauacuguuuugguuacuauaccucuguaauauaauuugaagucagauaauaugauuccuccaguuuuguucuuuuuguguaggauuguuuuggcuauuuuggcucuuuugugguuccauauaaacuuuaggauuguuuuguuuuauuucuauaaggaaugucauugguauuuugauagggauugcacugaaucuagauuagcucaauguuuuaaacccagcaggcucucaaauguuugcuagauaaauaagcaaguuaauuacauauggcaaaacucuguucuaaaaugugacucauugugauacauauuaaauagaauacaaacuaagguugaucucucaaaacauaagcuauacaugcuaaaguucaauauaacaaguaauuuuuaaggccuucuaauuucauucuuauaacaagaguccauuacaauuaauuuccuaccauuaccauuuauugagacaguuucccagaguuuaugcucauuugggucagucuucuauuuauucuauauauacaacaccauauuuuaagaaaugguauaaucugaaaguguugucugagucaugaaagauaaauuuaaauugauuuaguuaguauuauguauuuugaucccuuaaaaauugaggaccuaaauauuguuauacucaguuaauuacauuaaccagaauggaaacgugaaugguuauauuuuacugaugacuaaauuaagagggcuuugcugauuuauacaguuucucagaauuaacuauaauaacauccucuuuacaucaaagcugguuaugauaauuaaaaugacagcccuuuuuugauaguucuacucuaugccuuugaggagcuccuaaacugauagaagaagcaaggcaaucaacaaccagagacccaagugagaugaugauauaaaguuacauacuaaagaaaaaaguggugguaaagaaagucggaagaaggaaaagguuauugggaucaaucaaauuaaauuaaacauuuaguuuuuggugucacaucaccagaaauuaaauguuuaaauagugaccuacaaaaggucucauuccagugugauaugugaccuaaauuaaguacuuugcuaagcaaaguuuguuuaaagccuuuuuacauuggucaaaaauacuagucagguaccaaauaacugaaauuacugaauaucuuuuuucuuuauaccacuaucucauuuuuaaaaagguugugaguauaguuaguaaauaaaugaacuugcaggaaguuguugccuuuugguaaggucacugaauuuuagacuuuaagaaacaaauagugauacaaaaacuaaggauggguaaauugauuuuaaugcucuaagagccaucauauucaucauucauaaaauugacaaauaauaccuuuugagauaucagcuacuacucaauacugguagugaaaaguuauuauuucuucauuccacccaagaauaacauaguaacacuugaacuucuaacacauaccaaucaacagauaucuugccagugcuuaaaagguacagauuacaguguacaaaacacuaaacuauuaguuauuugaaauaugcuacuugagccaaacuaagauauuuguacauuguaaggggugggaagcacuugaguaggggacagaacagguuuguuuuuuuguuugggagaagaaauaacaugacaucuaucugcaauuucucugaaucauggagagccaaguaauguuauuauucugugaucauuaaauagcauaaccagaccaggaaugguagcugacacuuauaaucccaaugcuuugggaugccaaggcaggaggauugcuugaggccagccugggcaacaaagugagaccucuucucuacagaaaaaugcuuaaaaaaaaaauagguggccacgguggugcacaccuguaguccuagcuaccugggaggcugaggcaggacaaucgcuggaacccagcaguuugaggcuauaaugaacuaugaucaugccacugcacuccagccugggcaacagagugagaccaugauucuaaaaaaaaaucauaaccaaauacuuucugaauuugcuuccaauugcguucccuggagaaaguuuucauagaaaaguaaccaucuauuccagauguccuguguccuacccuucucuauccuuaucauuuauaucucuggaaaugauaaguaaccuauagauucuuuaaaaguaucaaguuaagaaggauguaaaugcugagaaauaagacgaagcagagauuguaugcagggcaagccauacuggugucauuuagaggcugaaucaagaacagaagaauccacucuuccuacacuuuccaaugcuuacuaaaagcugaauuaaguggccucagcuuggguggcauuuucuugcuucuaacaacauaacuugagcagcagcauuuaaaauauccucacucugccauguuuauuaaaagcaaaugauaacaaagaugacaugaaugugaaaaggucaauuucuguguguuuguuuuugcauuugucauauuauaagagaaaacuguuaauaguugauaaauauguucaaaaacauuccugaggcucauaaaaauaaauccaucucuuuucuauuugaaaaagaaaauauguuauuucaaauaaaauauuugaaacaaaagcuacagauaacgaagucuucuucaacaaacugcaaguauagaugaaaagauacaugugaaaaaaaauuuaaugcaacaaugaaauaacagcucaagaaaguaauagaaaagauguaacaaagcaguaugugguuaauugaccaaaauugaccuaauauccauaagcacagacauuagauacuauaggacucaaaggaaaaggaugaucacacauuagucuuagguaguugggaaguucuccaugaaaaaggugggcuguagacugggucugaagaaggaugagcagguuugggguagguggaaaggcauuucauguggguggaacagcaaaaguagaagugcaaacacaacugggaaaacacaaugcgugagaaaauaaggaaaauaauuuucucccuaggggagguaguagcagcuaaacagaacugcugcuaccaagcuagaacaauaaagacuuuaaacucucuaggcagggcagucauugcugguuugauguagcaguagcgugagucuuuggaucuggauaucuggagauuaucgcacuguccagacacugaaaucauguguaccuguggacuaauggcagugggguaugcaugaaugugagaauguuugcagaguaaguugucucuuaacuggugacagacugugugaacaagauugggagucguggcauaaaauacuuugugaacaacaauuggauauguggggcuuuccaagggagaagagaagauggucuaggacugauccugagaaaagcucacauguacagaacagcagaaagaaggaaacagagacauuacuuuccccucugauuugaaccucccucugaaaaaccagucugcacuguacaauguggagagacagacaacaaggauuuuucuugaagaauaaaauccaauaugacuuuacucuucacuguuuggacucuguguuauugagggagaaggggguaauggucaguuugaauaauuuaaauauacagacauauauuauauauuaaauauacauacauguauauaguaaauauacauacauacaguauauauuuaauauacacacauacaguauauauuuaauauguauauauuaaauauacauacauacaguauauauuuaauauauacacauacaguauuuauacuuaacauacauauauguauguauauuauauauacugaugcauauauguguauauauacaguauacagauauguacuauauacagauaugcagauauauacagaaauguacuauauacauauauacuguauacauauguauacuguauacauauauuacuguauucauauauguacauauaugaauacaguauauauauuuaauauugauauaauuggagugugaguaaaaauggccaucaagaauugaauugagagaacuuaggacaaaaacaaaguuuaaagaugcugaauuacauacagcuugggacagagcugaauuacagaugugagaaaacaacuggauauguggggcuuuccaagggagaagagaagauggucuaggacugacccugagaaaagcucacauguacagaacagcagaaagaagguaacagagacauuacuuuccccucugauuugaaccucccucugaaaaaccagucugcacugugcaauguggaggagagacagacaacaaggauuuuucuugaauaaaauccaauaugacuuuacucuucacuccucagcuauauauugguagaacaauuugaaaucauuuauuuggccagaugacuaauguuguuuaacacuacaauuaacuaauaaauaauuguaaagcacuuuguaaauauaaagugcuacauaaauguuucauaauaacauuaaacaggaggcuuaaguuacauuuuuauauucaaguauuuuauugguuaucgcaggagaaauaccaaaaauaugaucaaaugccauuauuacagucuguguuugaaaaauacagcaaagugauuauaggaaaacaaaaacaaccuuggccaugcuagggugaacagaguaguagacuagcaugaaacauuucccucaugaaaaacaagagggaaugacaacacgaucauauacauauacauauauacauauaugcaauauuuauuuauuggaauguauuuauugcaauauuauauuauugauugauugauagaaaagauaauuuaccagauaaaacaaugugaaagacacagaacgugagaaagcacaucaagguaggagcucugaggaaaccacuugacacaaguagaaucuuacaaaauaagaguaacguucuaugaaggacuuaaauuuauagcucauccacuauuuacaacaaugcauugagauguauaccacuagcacccccuauguugcauauaagagaacugaugcacagagagauuaagaaauauguucaauaucacacagcuaguaaguggcagagucaggauucaagccuagacaggauggcucccaugucuacugggaggaaucugggagagguuuuauuaucccgauaaaacaagacagguggagccauacucuuuccuccugccucagcacgaggacaggaaggcugaagcugcaacaacuguauugggaccaugagguaaaggacaagagaaccacagagucaucagcccugcuguuguuaaacuacuuaaccuaugccagcaaucacccaccucugcauucuuauuagaugaggacaauuauccccuauuuguguaacugaccacacccaggacuucuccuacuugcaaccuuaaccaauaugccaaauaauaauaaucaucaucauaauaguuaucacuuguugagugcuugcuauaaacgaggcauuauuuuauguuuuauguguguuuaaucucuucuaccucauuccaacucugugaagcaggcacuauuauuauuaccauuccauagauaaggaaacugaggcacuguuuuaucuggguugcccaaggccacacugcuuauaagggauuuaaauccagcacccuaacuucuaaacccucauucugcagcaaauaguauucuaaacagugaaagacuaaaacuauuucaauuaaaaaucagaaauuagcuagggauucuuccuauuuuaguauaccuauucuuauucaauauuauuuggagauucuaaagccaauguuucucaguaggauauauugacauuuugggaagacaacucuucauugugugggauuguugcacauaaacauguugccaucuguguugucuagguccuaggagaaguacucucuagacauaguguagugucagccaaaaauacccuccauguuuccccauacggaggcagugucaccccaguuaagaacuaucauucuagcgcaaauuuggcaaacuuccuccaaaaaaaguccaaauaguaaauauuuuaggcuuuacaggacaugcagucuuagucugucucgauugcaacuacuaaacucugacauuauugagugagaucagucauugacaguacauaaacaaauaagggggccuguguuccaaugugaccauauuuauacaugagaaagaaccccgaagcaccaagggguuaaaaaacuugccuggggugauucaucuaggaaguuuacauucauauucaacacaaaggcagagugauucuagggccugugcucuuauucagaacacuauugauuucagauauuuuaaauguuuuucuccuaguaaaaggaaggguaaaugccucaaacaccucacacuccagacucuggcccuccucaucugucugguguuggcugcuccuuccugcaguacaggccacccaagauuugcuucugugacagccuggaccaaugcuaccaaggauauaccucauguuuuacuaugcaugucccuaagagaggcucuccugguugacucuaacacacagucauccuugaaaccuccccaaauauaagauucuauaaaacugaucacuagaauaguuauucacugaucugugacuguuuuuauuuuucacaccucaaggucucauugucggugagcaaaaacagaaaggucuuagcucaugguauggcacauggaaaagcucuauaauaugugcuaauauuaauaaaauauacagaguagcaggcagauaucucugcuugaggaaugaauauguguguaaauucaggaacaugcauccaagcuaagaacaaccaagucaaucagagugguacaaaugagcaaaguuguaacugcugauucuguuagaguaucucagucuaggcuuuagagucccuacugugcuugccuaggaaaagggacccauaucuaaccaccuaggagccauacagauggagccaauuccagaagacaguuaauaucaugguacagaucaguggagucucaugagacuugacugcuaaucaguguguaagacacagcauagucauugccaccagcuguggggccagguugcaauucuucuauaauaguaggcaggugggggaauucagcaauaauacaaaagggcaggcuaccaaaauuaggaaaaacaaaaauauaauuaccucauaaugcuuuucuggaggaaccagaauaugcugcuuccaacauuuucugguuucuguagggauaugcuuuuuccaccacagauauuaaauauauuaggggaaauuaggaauaaagauuuuuaacagauuguccauccaauuauguuuaacaaauugguagauucuuuucucuuucaguauuuuuuuuuuaacagaauugacuuguuguuuuugcauuguguuaacaaaacccaaaaccaugauggaauuaaagaaaaacuucguuaagaacuuauagaugugaaauauaacaauguuugugauaaauacacauuucaaaucucuaaugcuuucauucaauaugaguaaaacuauuaaggaaaauguaguucuaauauuuuuucauccauuuuugucaucauuuuuuauccucuuaugaaaugauuucuucuuaauaagcacaaagcaaauauaauaaaguugugguagguaaauaacuuuaccuaauaucauuaauuacuaacagcucaauuauacugugaagugccuauaauugucaugaagcuucaaaaauccuuaucauggauucuauuauguauaugauucauuuaaauuacauuaauuauacagauuuuaaugaagcagagagacuacuuucaauuuucacaaguagacacaaugaucaaaauauuuaugugcauaucacguacuuuauucuguugacauucauaaaauaauucauuuacucagacaauauuagcaccuuuacaugggaaggaaaaaaggcaaaucuaauuucucauguuuggauuuaagauuauaugauccuuagaugguucuuuuauguaauaucuagcacaauuugggcaauauuuuuuggaaaguaaaauauuuaaacuuuuugacaguacuuuauauuagcuguaaaugguuuuuaagccacgauuguuaauugcauuugaaagcccagauuccagauucugacucucugaguucaaauacaaagauacucaggcaagugauuuuaacauucuguaccucaguuuaguaaucuguagaacagcaauaauaacuuuuuaaauugagaauuuaaagagugauaucucaaguguuuaaaagaaugcuuaaccauuaguuaaugcuauauaaaaguauuuuccauuauuuauuuuccugcuugggaggagcucaauuugacaugaauauuagcgauacccaauuucacccacauaaaauggguagggagagcuuuuuaucauuaaaauuccaugaaagcaguguaagaaaaucuugugggcuaaauuguaaaacccaaaauacugacuucccuugugauguggcuuugaauaguguggcagugaaaaacuuuuuaucauucauguuguuauuaaaaccuguuagaccaaugaccuaacuucaaccauauggaaacguggagaaacuaaggcagccaaaaauagcaguuuuuagauccagacaaguuugaggcuaggaaaugaggagaaucguaggcagagggugaagcagaaauauaaauugaaaccaggugucacuuuucagauaauccucuuucuucucuccauacuuccccuccuucuuccucucauauauaugacugccaggacuggccagggcauacugaacucagcacuccaaaaaggaaacuaguaugggaacagauaucauacuaguggcucacaucuguauucccagcacuuugggaggcugaggcaggaggaucacuucagcccaggaggucaagaugagccugggcaacauaggggagacccugucucuacaaaaaauuaaaaaaauuggccaggcaugguggugugcaccuauagccccagcuacuugggaggcugaggcaggaagaucacuugaucucaagaggucaagcccgcagugagccauaguugugccacugcacuccagccuggguaacagagggagacccugucucaaaaaaaaaaaaaaaaaaaaaagaaagaaaauacaguugcuuucuuuucaucacucaaacaaaaccagaaaauuccacccuaaauucaugugugacagacuauuuguugucugggaguuuggauuauaacacaaugagggguucugguucuggaggacauucagugaguagcugcuuguuuguuauuagaaauccuauccugcugaagccuuuauggcagaggaucuuuuagacuguaucagcacuggcuuuaaaauccuuuuguaacaguacauuaugguggacagcuuagguagggauagaaauaagagugaggauaggagaaggaaacuguuagaaugcuggguucaguauacucugggcaguccugggcaguccuggggagguggagagaguggauaggaaggaagaaguaagugugcucggguuauugugaugauauuuacuuugcaagauuauauuuguauguauguagguugagagucuaagauuuuauucuguaucgcuuaaucauccagaauuagaaagucuuuaaucucuuuuuuuaguaaauguucuuuggaaccuugcuaacaauuugccacuuuucuagagugguugaacuugauugcuucaaaucugaucuuauuucaagaaauacacugaccugcccuuaagguauauccaaguaaccucgauguucuucuuucugcuaaaggcuuccuggcaagccucccugcaacuuacaaccacuaaucugguuaaucagugagggaaaaaaugcuaugaaaaauauuugcuuauuaguugcuaauucuagauuuuauuuauauguguauuuucauaggccacauacauucuugaaauacagaaaccucauuugaaacaauucuuuaaaaacuuuauccugaaguggagcugauuucacucuacuuuugucucccacucuccuggcccacuccgcgggggcagugccaaugaauuguauuacccaagaggcagucagugaagaauaaacagggagagacagaugacucaauaagccaagauuacauauucaagacuugauuaacugaguguugaccugugguuugaaaguuacaaaaaugcuaagaugugauuuuucuuuuaggugggaaaugaagaaggaugaaacacuagaagaggaagaaaaagcaauacuggagcacuuaaaacaaauuugcaccccacagaacucuucugccucagauaacauagaggaacaguaaucugcagaaaacagcaacagcuuuauuuuaggaaacaaucccauguaauggaguaggauuuuuuaccauagucagaaugaaccucauaugugcugugaagcaugaaaccaaugacugaguaaucucuguacugaaaaggaauacagcacauaaaggauaaggugcuacauauuuuuuuauuuuaaaaauaauuucaaauguuuuucuuuccccaaucuuucucuuuauaugauauaacugcugccaucucguguucccuuugaauuauuuuuuucuccuuucagucuugaaguaucuaugacaacaggaagaaauguucagaaauuuuuuaaaggauuuuuuaaauacaacauuuggauguuaaguugaguggagucacauagccccaggaggucaucugaaauuuuuaauuuaauuuuguuguagcuguagcccaagucccaauuuuaauugccuuuacuauccacaauugugucaacuuuccucauucaauuuaucuaauuauagucaaaaaaaagcauucuccugaacuauaacuuuagucacaccucugcuuguagugguuuucagucuuccuccuaaaccagaaucaaauuucuacucauacauauucagguccuauaccaaauggcuccauguucagacaauugcuugccauccucuugguucaagucacaugcuugccauguuuucccaaucagaauccaucuuucuuccaaaauuaggcucaaaacuaauuccagcaaucuuuaccccaaagcucauuagcucauauaauguguuacuuuaaaauuuuuucauuguauugauacacacacacaaaauaagaaaacagaacaugcucuaguacccucucugccaaggacaauuauagauauuuauuauuuccuuccuaucacugccugauauuagauuauaaagacauugaagauauuaugauauaauaugaagucucccuuuauaacucccuguaugccuacuacaguguuauuucaucaaguggacaguuaacgaacacaauugauuaaauagcugccaaugaaagaaaaagacaacaaagagaauugcaugguugggcagucuaagaacgucugggagaaaccauauauauauauauauauauauauauauauauauauauauauauauaauuuuuuuuuuuuuuuuuuuuuuuuuuuuuuuuuucauuuuagaaacagggucuugcucuguugccuggaauguagugcaguggcaugaucauaguucaauguaaccucaaacucauaggcucaagcaauacucccaccucagccuccugaguagcuagaacuacaggugcaugccaccacaccugguuaauuuuuuuuaauuuuuuuguaaagaugaggucucacuauguugcccaggcuggacuugaacuccuugucucaagugauucucccaccuagcuagaacuacaguugugugccaccacaccugguuaauuuuuaaaauguuuuuguagagauggggucucacuauguugcccaggcuggacuugaacucccuaccucaagugaucuuccccucucugucucucaaagcccuggaacuauaggcauaagccaccacaccaggcccagaagccuuacaucaugggcuauuuuagaccauaugacaucaaacuucauguuuucugauguucucagauauauaauaaauuguccauacucccacauucugugauuuuuauaaaauauguguaggcuacaugauuuccaaaggaaaguacucaugcauuuuucaaagaguaaaagcuuggggugcagaggaggccacauuaggaaaucucuuacauuuuuucuuuaaauaaaaauacauaaauggccauguagacagcugccugccaaauaacacauuuuauuuuuaaaaaauguacuuuaguuggccaguauaaucauaaaccaaguguuuuuaagauuugguugaaguaauuucuaaaaauucuaugaagaccauuuagaaaaugguaggaaaauuuuaugagaacuggacauuccaucuaaucugaucuuuaaacagguuacuauaacaaucaacauaaggcaacaguugacuuuauuccuucagcuaagugguggucuguguacuaaaucugcauaacugugcuucauuagacaagaugcaaaaauggaaaguuaaaaauaaauuaauccaauaaacuagauacaacaucuuauaaaauuacaggauuucacauuuggauugucuucuaauauaucuaaacgucaucuuuuaaagcuauuauuauugaauucguauauuccuguauuaauccugggaaguaauuuugcuccuccagaaaaaaucuuuucuguggcucccuuuugaaagaaaggaaguauaguaaggggaaaaugggaugaguuuaaaggaagauaaaaguaggagagaaagaggccuugcaguugaauucuauucugugcuuguucagugaaauuauuauagccauaagugcaauaaaguuuauaauugagaguauuaggugacaagucauugauuuaucagauuauuuugacuuuauacucaauauguuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuacuuuuuuguauuuuuaguagagacgggguuucaccuuguuagccaggauggucucgaucuccugaccucaugauccacccgccucggccucccaaagugcugggauuacaggcgugagccaccgcgcccggccauguuuuuuuaaguauaauaagaagugguauuucaaagcaguuuuuguuucucacauuugugugaguuaacaacaggaaugaagccuaacaguuuauaucuccccauaugcuuauuacaaaaauauuaucuuccuauaaaguaugaucuuccuucuguguucugcuuaauuguauuuuuauguaauuauauagagauaucuauuuuauuauugguuuagcaguuacuaugugaaaacaguaugaaauaauuuuuaaauaaauuauaaagaauauugucuauuuca

SEQ ID NO: 192442 - RNA, 39689 nt, Homo sapiens
acuccgcgguccuggugccgcgugcaggucggugcgcgcuucucccgagguggaacgggcggcagucaagcgccggcguucucugccgucacccuuuccuugccggccggcacuucggcugcagaguuuugcccacgcuucgagacuuagggagcagguaaccgaggaagcaaucgaagacuugggagggguggugaggguagaggggaauuaaaggggcacguggaaaaggugaggggaagucagggguagagauucauuaaagcgccucugguuugaggggcguuuggagauagcuugguaccuccccuccuuguccugcucccuucagaauuuuuuaaguccaauuuccagaucuuaccuagucucuacuccuaggacuguuugcagugaguuagaaggguauuuaugcucuuacugauaguagguuauuuucaaaauccauggcuuuaugauuuuuuaggcacuagucauugccgcagauugcagcugaggaccgacuauucaguaucuguuuucguaacuguuggcacuuuauaucguagggaagggaguuguuaauaugguuugucuuuucuuauaaaaaauaaaauucuauauccacccuuuuuuuaauuuuauuauuauuuauuuauuuauuuauuuauuuugguuugucugcccuuggaagagaguaaagcgaguugguagaaaggcucaaauaaagaaaaggagcaccuggugaggacgggaaaagugaauaaugacuggguguggccccgccagccacauaaaucauccgcucuguuaacaucaggucacugucuccacuccccgcuucccagcuauugaaauaucuauuuaggguuuuuguuuguuuguuuguuuuuugagacagagucucuguugcccagucuggagugcgguggcgcgaucucgucucacugcauccuccgccuccuggguucuagcgauucuccugcuucagccucccgaggagcugagguuacaggcgccugccacugcacccggcuaauuuuguauuuuuaauagaaacgggguuucaccauguuggccaggcuggucuugaacuccugaccucaaaugauccgccugccucggccucccaaagugcugggauuacaggcgugagccacuacacccggccagaagcaucuauuuaggcuucagaaauucccuugagaacuuaacuaaccucuuaaguuagucaggaaaaaugauaaagagacucaugagacagcauuacaaaagaauuaugauaaccuuuacugugacaacuacuaauaagccuucauggaaggagagguguacgcuccuuuccuacccuccuaaagucuuuggugggcaugcagcuuuucuaaauacuuugcuaaucuucacagagauuauucgguuacucagcugggggcuuuccuuaugcacaagucgcugagcuggguaauucaugaacagaguuguguaaaaaggucauaaucuggauucucaggaguuugagggaagauaaugucuguacacaauuacuugcaaaauaaagcauuacgggguauguaccacagaggaaguaaaagcuagauucaguaagaauacagguggaagggauucgugaggaguggcuuuugagcuggccuuaaaagacuacuuuuagggcauucucagcagaguaauauagggcccucaguagucuggguacuuuuucucuaggcagaagcaagccacuaguggugaaauggagugauaucucuaccaggccaugagcucagcaauaauuuauccaauaaucauuggccuuuugcuaggcuuucguuaguaauggggacauaaaaaggagaauaaguuuccaaggagaccuucacacuuccaggucccccugccugcaucccacaucucacuggauauccuuuuuuaauucucuacauggcucuuugccuuacuuuugucaggcuuaugcucagguaucaccaaguaagagaggacuucuucagccacccuuuccacaauagcauccauguuuccugucuuuauuuuucuuaucauuuccugacauuuccuauaaaauauauuuugucaguuucuuacccuagacuaugagcuucaugagaggagaaauuuuguuuuguucacuacuguauucccaauucauagaagacggccugacgaugagggugcuuaauaaauacuugauuggauugaagaggcucccugggagacagauaagagcugacaguuacaacaugauuguaaaaagggcuuaaaagcagaguaguacuugggaaacacagagaagggagaggccuaccuccauguaggguggaagaaauugucauggagaaagugucauuugcauggcaucugaaaagaaccuggggcuuaaguggauguggcaggaagggcacuccaggcaugcaaugguugacuuggccacagcguggggugccuguggugagaggcagaaagacuccaaagcucuguuaaggagagucacaugucaagauuuguauuccagaaagauacccuagacugcagaguggauugaaagggagaauccggccacaggaaguuuauuuguucuguuuuagagguccaggugagagaugagagggucugaacugaagcagagguggaagaaacagaacaugggagagagaacagagcugguaaaccucuacuauuagaugagggguuggaaguagacaggucagaauaccuauccugauuguagcaauuuaggggucauucaucaggaauaauaccgugacuugacuuucacugccuccucuagcuucuaugucugcuucuaucuguuugugcauuuauucauggagcugacguuguuacugguggaggguguccagguucuuggcgucuugaacaaagaauuggacgaaacgcgcaaagcaaagaaagaaugaagcaacaaaagcagauacuuacugaaaaugaaaguacacuccagugaggcaguggguggagcauaugggcucaaggguccccuuacagaauuuguggggguuuaaauacccucuagggguuuccauuuaguuacuugguguacacccuauguaaaugaagaggaugaaguaaaguuacaaagucauuuacuuggcauaugcccuauggagaggauauuuccugucauagccguaaugugaauuggccuuuuguucccugccuccagacccuauuuuccugccucaguguggacaaggaacuguguaagacguggaggacaagacauuucaguuaccucauaacucauaaaauguuagaacuaggaggaauuucagagauuagcucagcaucugcuaggacguuguuuugguaguugauuaaaauugacuuuuuuauuucagcucuuggaugcuuaaacuacacccauuuucaaaccucucagaacaauucugaauagaaauuuucaggagacauccugaaauggaaggggcaaugcuacugauuuuacauuuuuaauugagucuguuuugcaguuauuaauucacuucauugaauaaagaccucccugggauuaaaaaagucuucuaaccagccuagaccuaugcuuccugaaguguaaugcaaauggaagaacaguggaaagguaaagcaguccugcuuuuguuaggaauuagcuuugcgucuuuagguaaucaaguaaccgcuuaggguguugcuuuccucuucuguaaaaugggagguuuaaucugcgugguucuuuuuuuuuuuuuuuuugagagggagccucacucugucgccuaggcuggagugcagcggcgcaagcaaccuccaccucccggguucaagugauucuccugccucagccucccgaguagcugggacuacaggcgcgugccaccauguccagcuaagccuguagucccagcacuuugggaggccgaggagggcagaucacgaggucaagagaucaagaccauccuggccaacauggugaaacccugucucuacuaaaaaugcagugguucuuaauuuggguugcacacuguaaucuccugggaugcuuuaaaaaguccugaugcuuaaaugguaccuccagagcuucugauuuuauuguucuggggugaauccuggguuuucuuuucuuuaaaaccucucucagugauuccaaugugcagccaggucccacucaaagaaagggggaaaaaagccuuaauaaugggcugacugaauuguccuucuguggguagauuugcucaucaaaucacagugcacaaauaggguaagcuugacauuaauuguggagcuguugcuauauaggaagcacuaugguagacaguagggaggauaaaaucccugcuuaacacagaaccaacaaacagccaggcgcgguggcucaugccuguaaucccagcacuuugggaggcugaggcaggcacaucaccuaaggucagaaguucaagaccagccuugccaacauggugaaacccccaucuuuacuaaaaauacaaaaauuagccgggcuugguggcaggcaccaguaaucccagcuacucuggaggcugaggcaggagaauugcuugaacccgggaggcggagguugcagugagccgagaucgcaccaaugcacuccagccugggcgacagagcaagaguccaucucgggaaaaaacaaacaaacaacaaacgaaaaacauaggugaaacuccuccccuuuggaaaagaucaauuucccaaaagugguauucuauuucuuugaaaauugacaaguguggcaacauauaucaccugaaauuuuuuuuuuuuaaucuguguuuuaacaggaggaucuuuccaagagcaaugugggaugaagugguuguugugguugcugagggacuuaaacuggcuuuuuuggugaaaagggauguagcaagucagggaggcagagggaguaaguugcaguggaaagacugguauucaagacaugacuauagugagucaggagaauagggugcaaccaucuuaaaagggcucugaguaaauagggaguuuggauuuaauucaguuagccaagagggaagaugaggagaguagcagaaucaaaacugugcuuuaggaugaguaauguggauccauaaauuaaacaggaagaacaagggauaccacaaaguuugcaguuaaucagaagugaggugaaaaaggacugagcuggauuaugguagagaaauugcaaagaaagugacauuuagaaagaauaugauugaucagugcucucuggcuccuagcacagugccuggaaugcucaauauugguugaaugaaugacucaaugaaauugggccauaugaaguagagaaacauuuggagcaugaggaaauauagaaagcacuaaaacuccuuuauucuagaguuugguguauugaaaaaggaaugagacagugguuaacucaaccacagucucacuuguaggcuguuucuuucaugauacauuuaccaggauccagggacucucucugagcucugcaggagaagaaaaugaauuuaucagcuccucuguguacaggguaauggauucaugaaaacuaacuuaaagagauggguuuguaggcuggaaugccacauaauuauuaaaugugucaaaagcuaggaaguuuuucuggcaagggugguaccuucgcuaaugauagcaauucauacacccaaagauugcuugauaaaaauggaaauuuagagucaauagaguuuguuauuuuucaagagcuguuccaugaagcagugcuagcugguguccucuuuuuuuagggugaguuuuccaaacuuuuccagggcccaccuccaaagauucugguaugguagguuugagggcuugaagaaagccuaggacucuauguuuagcagguccuccaguuaauuuucaugaugaggaaagucugguaaacuuuaccuggaauuguuuuuaaucuuuaaguaguggcaaauccuggacuggagugcagcccagugguuuugaguaggccuagugggcucuugcaguuguuucuuagagugaaaggugugaccccuucugcucagcaguuuugauacuugggagauacgcuuucucuaggcucagcauauguuuuagugacucagcaauugaaacaaguccauuuggauauuuuccugcuuuuuuaauguagagagauguaauaagcugggcuauuaaaauaaauauaguuccuguaugaacuuuauuucaagguaacuaaauaauagauaagagaaauugaucccugguggaauuccaauuaauaaaacagaaagaaagauaaaauuuguauaccaccauuuugcaauucauaauggaaaaauugaucuagauugugaucaucagugacugcuaaaaucauuaggugaaaacugauggacacuuuauacuuaaugaaauagaccaacaccugaacccaugaccagccugaucaauaccaagagggagacuuuauguucaucuugauguaauagagaaggaaagagagagcaucccuuuucaguauucuugaaaaaaaaaaaaaaaucaaacccaaaucuaaaccucuaguuuaccuguuuauuggaaauacacccagagaauacaggaauauguuaaaucacaucucagguauaaaucagucaaauccagaauaugggaaauuauauagcuuugcuacuuucaaaguaugguuuacaaaccaguugaugucuccugagaccuugauaaaaauucagauucucaguuucugucugcagccaacugauucaaaaucugccuuuuaacaagauuccuagguaauucucuuguaccuaaaguuuaagaagcauuguauagggcacugaccuaguuucuuagacaaauagaaagaaaaaaaaaugggaaaaccauuacaguuuaaaagaaaguuaaaugucauguauuuuuuauaucuugauuugaacaaauuaacuguaaaaacauuuaugugauaacuaagaaaugugaauguuaguucuauauaagaugaugguauagaguuauuguuaaaauuguagaugcaauguuauugugauuuuuuuaaaagcccuuaacucugagagaggauacauacugaagaguuuaaaauaaucugaagcaugggaguagaaaaguauaguuaaaguacaauagucauauacggauaauuuugaagcugaguaguggguauauggagauuuaauauacugacuuuugugcauguaaguauaguaaauguaaguauuaguaaaccaaaaaaggcauagacuuguaguuuaaaacgacaacauuaaagaugacaaaucaacuuuuaguguucaagcaguuaugaaggaaaacucaaauauggaggccugcagggauaaauuuacgaaaugaauaauguaaaacuaugaaacccaaagggagggauugaaaccaacuuugcaaaagucauaacugagaaaauuaugacagugaaagauaucagaccuaauugaucccaucuugcuucuaaccucugaacuguccuuguucauucuugggcgugaaaccaccuuugcaaaauuaugacugagacagugaaagagaucuaaccuaacugugacuccaucuugcuucuaaccuuuaagcuguccuuguucauuccugggcauaggcugaacuaacuuugggaggaaauuaguuuaugguuugaaacaaagacgauaacagacuuucccaaaacaaaccuccuccuugccuggggacuagacugccauugucggacuaagaaauuauucacaagauuagaaauuauaguuucggagucaugcagcuggaggcuacaagauucugacccucccuaaaccacuccaaagaucagugcuugagauauuuugcagacccugcacuugauggaucagggggcacuacccagaucgauuaacugacucuucugaucuuguggcccccacccaggaacugacucagcagaagagaacagcuuugacuuccuaugauuucauccccgagccaaccuaucugcgcuuccaguucacuggcccccuacccaccaaauuaacuuuaaaaucucugaucucuggcugggcgcaguggcucacaacuauaaucccagaacuuugggaggccaaggcggguggaucaccugaaguugggaguucaagaccagccugaccaacauggagaaaccccgucucuacuaaaaauacaaaauuagacaggcaugguggcgcacgccuguaaucucaacuacucgggaggcugaggcaggagaauugcuugaacccgggaggcggagguugcagucagcggagaccaugccauugcacuccagccugggcaacaagaccgaaacuccuccgucucaaaaaaaaaaaaaaaaaaaaaucucugaucuccgaguuuucggggaaacugauuuaaggaauaauaaaacuccggucucccgcacagccagcucugugugaauuacucuuucuguauugcaauuccccugucuugauaaaucagcucuguccagacagcaggcagggugaacgccuugggcaguuacaaaaucauaucugaaaauguucucaguaucauagccauuaugucaaaucaaaugccgugcauucuacuugaguaauucacagaaaacaggaaacgauguuucauuacauaaagauguugaauauaugauuugcuucuggggccuuaaauguagaaggacauuaaaauuggccaucauuggcagggugccauuggccgggcacgguggcucaugccuauaauccuagcacuuuggaaggccgaggcaggcagaucacuugaggucaggaguuugagaccaaccuggccaacauggugaaaccccgucucuacuaaaaaaauaagccgggcaugguggugcgcgccuauaaucccagcuacuuaggaggcugagacaggagaauugcuuaagugagggagggagguugcagugaaaaaaauaaauaaauaaaauauuuaaaaaauuaaauuggcugucuaaaagugcaaugccuuguuacugcuauuccuugcaaaugaauuaaaacuuggacugccacauccugaguguuacauagauuuacagcaauuauaguuaucuuaccuuuaaggcaaauauuuuuaaguugcuaaggcuaauuuuauaauuuuaaaccucaaagaugagaucuaugaaguccuugauucuacauguguauuuuaacucaacuacuccuuaguagcuaagacuuccaccaaaacaguucuaccaauacucuuaacauuugcuguguauuagaaucaccugggaagcuucuaaaacugacucuugcccaauccucaccccaagagaucuggauugauugguucaguucagugauucacagaacuuagcauacauagaauuaucuggaaggcuucuuaaaacaccagugcugggcccacucacaguuucuuuuuucuuuaggucugugguggaacucacaguuugcauuucuaccaaguucugagugaugcugcugcagacagcacucuuugagaaccauugcucuaguuucuuaagccacccaagucauucuaauggcagccaggguugagaacugagagccgcuugcuuuguaguguuggcccugugauaaagugagcugggaguuuucagccuuuugguccaaaauagugccuauauucaaauuguagacaguaaaauugauauaaagacguagcaccuuguugguuuuacguaguguuccuucaccauuaaugugguagacuaagaaggguaacauuaaugaccaggcaagaaacccuggugaagaguagagcagcugugugaaguacuguggcuugcauaauuuugcaaggagggcaagugaguagauucagaaaugagacugagcugauggggccaaaaccaaugccacuccucugacuuccuccgagugguccaggggacauaccauuucucucuuggguucaagggguuaaaugaggcucaguauuaucagcagggaaagaaauguaaagaaugugcauuauaaucaucacuacaguugaaugcagacuucuauugaaagaacucuagcguagggaucccuguuuauacauuggcagcucaguucucauaguauaaucagaggauucaaacguucaauacaacuugcauaugugauaucacuccugucuccaaaauugaagaguacagguuuaucauaacuuuaaugauuuuaacuguuuuucucugaauuuuuuuuuucuuggacaggcaucuuucgagucucauugaucccauucccauuucuagaaggaagacauuggacuagaucucagggauucuuccaaacacucacaugcuaagauaaaucauuuaaagucuuaaaguauauaugacuaaugauaguuuuuauguugacaugaaagauuucuucuccucaucagccuggucuugucuuguguccacuuuuuauguacauuacaucugagauccuacugccaaaccacagaagggugggugaauugcguggacuggauguggggcaguagugggugaggggguugaagccaucauuaucuuaccugccagaggugugugagugugagcaguucaacagucaguugucacauguuuauuuguguacauguuuugcuuuccaaaaguauuuuaagucaacugugcuacuuaaggggugcaguuuuauauuuugcuuuaaaguguugauuucuuuuuuauaugugauccaguaaaucguaaucauuaauagugccuuucagaauuugcccacucaucugguauaacugguucugauggcugggaauaaaggaagaggacgugcugcuuauaccuuuaauauugaggcuguuggauuuagcaaaggugaaaaguuaccugauguaguguugaaaccacccccacuauuuccuguaaguauaugaacaguugaauucucauaguguguuuuuucauuuuucagagaauauuaaaauucuauaugggacuggauguaugauuauagcauccucaaguauaagaaaguaaaggagaguguguuucacuuaccuuuaaauauuuucaugaucugcuuucuuaaaauauagaaaacaaaacuguauacaucuuuccaugaauauauuuaguacuaugugaaccaguaaagaauuaguuuucaauucuuacaacuuguauugguguuauugauaaauuccaauaugaaaauaauaguuuuaaaagucauuagguuuuauaaugguucucaguucgcacccuaucacaccuucacuuaaugauuuucuuaucuuguaucuauagaauuuaaguuugcuccuuaguauaccacuugacuuuuucccccacugaacuuuuuuugcuuauuuuaguguuguuuuaaaauuuagugaguaugcugcaagcuuaauuuccauaauauauaauguuuucgcuuuauguuuaguuuagaauguauccagggaucuagauguaucacacaaggagucucugcguuuugcucuugguauuuuaccuuuuugauauucagcgcagcauaaaaacaaagacaaauaucucagguauuggcauaaugucacuuuacagugcuuuuaaaaacaagcucuuuuccaugugugaggagauuaccucuaaacacuggggauguuaguacauaguauuucuuuauacuuggaauaaaauuaaaauuccuuacuacuggguaaaaggcucugcccgaucucuccguucugaugucucucugacccuuuuucuaccacuguccucauuccccagcuacgcaggucuccuuggguccucaggccuuuggcccugcugguucucugcuggaaccaucucuucucuuugcauggauggcucccugauuuuaucccaaucucuacucaaaugugaccuccccaagaggccaggcaugcucacccugcauagauuccaccuccauccuccaugcacugucagucauuuuuccuuuacccaccuucauuuauuuuuaugucauuugucacuaugugaaauuguaugucaccucauuuguuuacuaauuuguuguauguugcucuccuagaauguaaguucccugugggcagggacuuugacuuauuuaucaugguauccuccauagucuaaacauguugaguacucaauaaguaguugcagcaugaauguauacauuccuaaucaaauuuugaaaauguaccuuaucuuuauccucugaaaucagaaaugucuuuacuagguacccuggagauccacuuguuaaugaacauauuuguguaaauauauacacacauacaaacgcguauuuguguauauguauguguguguauaauuuuuaaaacuugaaaugcagcuucaaacuccaucuugccauuuauucacuucucaauuucuucacuguaaaaggauaaauauugguagcccuuucaaugagauacuggauguuggauauugaguauauuguagucauagcaaccacuuacuaaaugauagcugcugcuuuuuuauuuauuuauuuuuuuccaauaauaccaccacuagcugagguuaauaagaaccuaaagcagcugcucucauuuggguaccuuaguuuuucuuuuuuuuuuugguacauuaauuuuuuuuuuuuuuuuuuuuuuuuuuuuugugagacggacucuagcucugucacccaggcuggaguacaguggcgcgaucuuggcucacugcaagcuccgccucccggguucacaccauucuccugccucagccucccgaguagcugggaauacaggugcccgccaccaugcccggcuaauuuuuuguauuuuuaauggagacaggguuucaccauguuacccaggauggucucgaucuccugaccucgugauccaccugccucggccuuccaaagugcugggauuacaggcgugagccaccaugcacggccugguacuuuaauuuuuaaaguagauaaucacauaggucaacagacuguuuggcaaaaugauuauugguguaguuuucagggccaauaggaaaauuacgcaucuuucuuaccucuaauagaagagcaaaguaggaaauggguuaacagguuaaauagacuacagaaguucaucuuuuaaguugguuguaaaacuuagugccuguaaaacauaguauuucaauaaaacugcuguuuucuauaauacagauaaaagggauauuaaaauacauaauugauuugaaaaaaaucuuugucucuuaauuuaaacaggauacagauuauaaaccagugccacugaaaacaggagaaggugaagaauauaugcuggcuuugaaacaggaguugagagaaacaaugaaaagaaugccuuauuuuauugaaacaccugaagaaagacaagguacuguauuggagucuuugauuauguggcuuaauguauacagaugaaacaguguuuaagcacaagauauauaaucauuuaauguugauugauucgauucaauaaaaaauuaucaacuacuuugaaaaagcuauuuauguugcuuuaacagaaaaaauacuuuaaacuuuuugauauuuuauuuuuagaaauaucuuucauuauaauuuuauauguucagugaaaauuaugaaaaacaggaaaauuuuaaaaaguaaaaauuacccauucuuaugucuagagaaccacuauuaauauuuuaguauauauuccagauuuuuucuuaugcauguauauucucuuuacaaaauuagauucacauuacuuuguaucuuccuuuuuucacucaguagcauauuagcauuuucacauauccuuauuauucuuggaaaacaugacuuuuaaugacugguagucuacucuguggauauauuauuauuaacuguaacuaauuuccugcuuuuuaaauauuauuuucaguuuuuugcuuguauauauaaugccgugauuguuaucauuauacauaaaccuuuaugcaugucucugauuauuuaauauuuagguuaaaaaaauuuuugagacuuaauuuuguuugguuuaucauuuagguguuugauaugauguaaaauauguauucauuggugcugcuuagggaagaaaggaaacauuauaguuggagagggcucaacagucucaggcuagaagugggaagugguuuuauaggaaaggaaaccauuccugaguagcuguuuagcacagcaguacuauauugauuuuucacuuucugcccuugauuguugagauuagagagacugauaucaucuuugaguucucaaaacaacaucauuaaaacaugagaaauucguagugucaucucauuccauucguauuaaaaaugcauuccauuuuuccucucucucuagaauaguuugaauuggcugagucaaaaaaggaagccuuauguaaugaucuuagcaugugcuuauaauuauaggaagcauuuuagacaaauucauuuaauucucaaaacauagcugcuuuaaguuauauaaugguuugauaagaaauauuuuaucucaaaaauacuuaauuuuuuuuuuuuuuuuuuggaaaugggauggagucucacucuugucacccaggcuggaguguagugguacaaucucggcucacugcaaccuccgcuuccuggguucaagugauucucacaucucagccuccugaguagcuggaauugcagacgcacagcaccaugcccggcuaauuuuuguauuuuuaauagagauguuucaccauguuggcuaggcuggucuugaacuccugaccucaaguggucugcccaucucagccacccaaagugcugggauuacagacagacgugagccaccaugcccggccuaauacugaaauuuuuaacucucaugaugauguugcaugcuuucgucuguuugaguucuaaaauaaaacuuuucauuuuaaagauuuuaaaaaguaagaccaaaugaacuaaucaguauucauucuuauuagaaaaaauaguaaugcaggguauacuuuagugcuuuuaaaauugaucuuuucucuaugacacagaugcacuuaggugaaugugguuguuauuaaagcacaugucuaauuuaaaaguaugucaaaucagacuggacacgguggcuuacucuuguaauccuagcacauugggaggcugaggcaagcagaucaccugaggucaggaguucgagaucagccuggccaacaugggaaaacccugucucuauuaaaaauacaaaaguuagccaggcaugguggugcauuccuguaaucccagcuacucaggaagcugaagcaggagaauugcuugaacccgagagguggagguugcagugaacugagauuaugucacugcacugcagccugggugacagagugagacucugucucaaaaaaaaaaaguauaucauauaauuaaagcauuuaugugaguguuuuagacagggauauuaaaaacauaauuuuguuguuggucuaugggagugguuggcuaguacuuggauuaaggggcacuuuaucuuugauaacuaugcaauaaaguauuucaaaauauaaggguuuuuuuuuuuuuuuugcuuuuauuucuuucaggggaaaacucuuguauagaaauuuccaaauugauacaaguacauucucccugagaucuucauguuuacuucugucuuuuuuuauuuuauuguuuuauauuuuauuuuggagaugaggucucgcucugucacccaggcuggagugcagugggacaaucauaacucacugcagcuuccaaacuccugggcucaagugauccucccaccucagccucuugaguagcugggacuacaggcgcacacaccaugcccggcuaacuuuuaauuuuuuuuuuuuuuuuuguagagacgggagucuugcuuuuuugcucacacuggucucacauuccuggcuucaagugauccucccaucucggccuuccaaagugcugaaauuacaggcaugagccaccgcacccagcuuaccucuguuuccugauauaguguuuaaaaaacacacgcauguuaaaaauaaagguuuuucuauaaaauauauacauuuauaugugccuauauagguuuauauaauauguguauauaugugcauacauaaauuuauauaauauccaugcuaugagugaaaaagaauuggccagacugaagagaacgacccuacugucagagagaaucauauuccggauagagauguugcaugacuguaccuucgccaggugcaucacuuaccaccugugugcuuuaggaaacagagacuuaagggcuacuguaaagaacuaaaucacuagacacuaggacagacaaauagggugagagaucucaagacuuccugauagucaaguggcugguggcucagggcauugagaucaguccucaagaacugauggcauggaaugaacauauuucauguugcgaugucuucaaaguuuguuuuuaauguuuucagguaggauuauagaaaugauuaguauuuucuuugcaucgaaauuuguuauuuauauaauaaaggaaaaacaccaaugaauauuauuuuagugaauuuuagcuauaagagaucgucuagucuagugguucccagcucagguuccugaaccacaggguccucugaaguagaaacaugauucugacaguggugauagugucauaagucauuuucagaaccucaaagcuuaauggaaauuauacauuuacuuaaauacauccacaggucuguuacugaauaaauggaauuuggcuuacuaauucuugauauaccaucaguguccaugagacccaauauaaauuuuugacguuuuuuuuuuuuggagcaguucuuauuguuuguaugauuaauauugauaacuuuuauucuugcauagagguuuucuaaagaagaaacagacauuuucuuaaaaaggaaaacucauuuuaucauagaauaccauaucagcccauuggacccuuuuauauaucuaaaauaauuauggaaucugagugaucuuauuuuuucucuauauugaaauaccuugcuacuuuaucaucauacauauuaucucaucacuauucaucagacauuccccacuaugcugaaaaaaagaauaaauuuaaaaaaugggagaaugaugaaauugacugugcaauucaaauaaauuaucacuauuaugucaucauauaguuuuccuaugguguuguccaaagcauuacaucuguuuuuuaagaaguuauaaagucuucagagacucuuauguuuguaguugcucuguuuuaauuuucauuuaauacaauugaaaauuucaaaaauuuuuaauuuuuugcucauaaugucuaaaauugacagaaaaacauguuccacaauucuuagacgaaucagaagucaaaugcaaagagauagauagcucucuggaugcucaugaugaugaugaaauugauuguauaagcaaaaucucagacugugagucuucagaugacagugucuucaaugaauuuucucaaauucaagaaucaaugaguaaacacuguaucuccaagaauuaaaaaggaauuaugguggccuucuacagucaaucuuugaaaaagaacucaucauguaauacuuuguaacaaaaaccuggaacauccuguuugcuaaaaugagacgaucauuuuuguucuaugauauuugugcaccaaaauuaauuugauguguuuuguaacugacaaaugcugaacauaaaggcaaagacaacaaugauugaaaggaaauugauuauauagacaugaaauuguuuucuggauugauuguguuaacuggugauuauaaauuuaauaaugaaaauauuuugcaaguauagagcaaagaagauggcugggccauccucucuucaauagaaguaugagacaucagccgggcgcaguggcucaccccuguaaucccagcacuuugggagucugaggcagguggaucacgaggucaggagaucaagaccauccuggcuaacauggugaaaccccgucucuacuaaaaauacaaaaaauuagccaggcgugguagagggcaccuguacucccagcuacucgggagacugaggcaggagaguggagucaaccugggagugagccgagauugugccacugcacuccagccugggcaagacuccgccucaaaaaaaaaaaaaaaaaguaugagacaucaaaguuuuuuaaaguauugcauuuuggauauguaaguacaagaagaagaauuggaaguagugauaagcuagauucuacuagaaaugcauuuauaaucugaaauuauuuagaugauacacauaugagaaaaccagaggaaauuauaaguuagaaccuauuaaagaugucuuuggaaucugggaucaggacguacagaaggcauauauucuagguuuguauguggcagccgaugcacagaaaacugcauucaaaugacuuugcccauuuugguuaaauuuaccuucaaaaucaguaaaacauguaauauaaauuuggauuugcuauacuuaauugcuuaguaaaaucuccaauaacuuuauuuauuuauuuuuauuugagacaggaucucguucugucacccaggcuggaaugcaguggcauaaucucagcucacugcagccuccaccucccaggcucaagugauccucccaccguagccucccaaguagcuggaaccacuggcaugagcuaccaugcccagcuaauuuuugcauuuuuuguagagauggggguuucaccauguugcucaggcuggucucgaacuccuggacucaagggauccagcugccuuggccucccaaagugcugggauuacauccugagccacuguguugggccuaguuuuauugauuuuuaaguaacagcuuuacugagacauaauccacuauauaaaauuuacuuuuuaaaguguacaauucagugacuuuuaauauagccacagaguugugcaaucaacaccacuauuuaauuuuuuuuuuuuuuuuuuuuuuuuuuuuuuuuuuuuuuuuuuuuuuuugagacaagagucuugcucuguuacccaggcuggaaugcaguggcauuaucucaguucacugcaaccuccaccuccuggauucaagugauucucuugccgcagucucccaaguagcugggauuacaggcacgugccaccacacauggcuaauuuuuuuguguuuuuaguauagaugggguuucaccauguuggcccggcuggucuugaacuccugaccuauuagcaaucuaccugccccagccucucaaagugcugggauuacaggugugagccacugugcccagccacuaucuaauuuuuuagaugcuuuucaucaucuagaaaagaaauucuguacccuuuaguagucauucccuacucucccuccuuccaacccauggcaccagaaaucugcuuucugucucuagagauuccaugucauauaaauggaaugauguaacaugugucuuuggcuucuuucacuugccauaauguuuucaagguucauucauggcuuaguacauaugagugcuucauuccuuuuuauggcugaauaauauuccacuguauggauauaugccacauuuuguuuauccacucaucacuugaugggcauuugggucaguucacuuuugggauuacaugaguuaucuugucauaaacauucauguacauguuuuaugugaagacauguuuucauuuauauuggguauauacauaggaucauaugguaacucuguauuucacauuuugaggaacugccaaacaguuuucuaaaguggccacccgauuuuacauucccaucaauaauguaugagaguuccaauuuuuccauauccuugccaacauuucuuauuuuuuuuuuauucuagccauccuagugguuguaacacaguaucucauugugguuuugauuugaauuuccguaaugauuggugauguuggacaucuuuucaugcuuuuuguccauuuuuguaucuucuuuagagaauugucuauucaaauccuuuaccucuuuuuaauuggguuccaauaauugguuuucaauaucuguucuuuuaucuguuaucuuuuuuauuuauucucuguauuucauuauuugaaauuaacuuaaaaauauuuuaaaauauaaaaaguggucuacuguacccagagaaaaaggguaaaaacuguuuuuuuccgguauacugaggguuaaaauuauuuaaaauauggaaacuguuuuggagaaaauucuuaaaaagaagucauuguguuacaaauucuaggaaucucucauuugugcugacuucguuuuauagauuaaaaacuuggcaagauuaguuaaaacauuuuaccugaagucaaacaguuaaaauaccuagaaaaaccugaucucuuggucucugaucuacuacuuauuuugguuaucuuucucuaauacgugguuguauuauuuggaagcauauacuugacauagaagaaaaaucaguauauauuugguccuugauuuuuauccauucaucuuuaguauuaccuucccuuuuucaugccuaacuccugaacuacuuuuuaugaugaacauggcuucaagcuuuugugugauaguguugcuuuccaacuugugcugcuggaaaagaguuugugcccuccuuaaggguguuucuugugauaagguggacuagucugaaucaagagccgcaguuauggcuuuacugguuuuggcaagcucagaggguuccugcagaguuuucagcaauuggcauguagggcuugcagcuugcucauuuaugccucagaucaguaaccccucaccaaguccauccuugccuaccccuacccuuuuucccauucucuuauguacaaaggugggaaacucccuguauguaaaauuaaaaauguugucuguuguuuucaauaaucuuaaaggaauggcuuaaguucaggguuacuguugauuuuccuaaugaguucuuuauucuuuuuuccccuagauauugaaagguauaguaaaagauacaugaagguauacaaggaagaauggauaccagguaacuacaaaacacacaauaugaaaacaguuuuuaaaggcugucucucucaccucauguuuuuuuuuuagaauaaguuuucuauuuuuaccauaggaaaacugagucugguucuuuuauugugauuaauuaguaaucuguuagaaacuaaggugaaaagauuuuuaugcuaaaacaaggaagaguugaagugcuuuuguggaaguucuuaaaauauauauauauguauauuuuauuuuauuuuauuuauuuuuuugagauggagucuugcucugucgcccaggcuggagugcaguggcacgauaucggcucauugcaagcuccaccuccagggaucaugccauucuccugccucagccucccgaguagcugggacuacaggcccccgccaccaugcccagcuaauuuuuuguauuuuuaguagagacggaguuucaccguguucgccagaauggucuugaucugaccucaugauccgcccgccucagccucccaaagugcugggauuacaggcaugagccaacaccccccacccuuaauauacauuuuuuacaaaaauaggacaggccaaacaaacccuuugaauuuuccaauuuaauuagccacaaucacaauuuuaauuuguaauaccagaaagcacaaauacuaugcuccugagcaauuuuagagcauuugaagagaaagcaaaaaucucguuuuaaagauauuuuaagccaagcucauggaucuuccuuucuuuuaagcagacauagacuaguuuuaguuguuaggcuucuucaaaagaaccauauccaaaaagaagcuuuaccuuggguauggacaaguuagaagggucuguaaaggagaucucaucccacucauucauuuugcaaauaaaaacaguugucauagaaauaaagugaccugucaggccauguggccaauacuguuagaacccaggucuucucauuuuaauucacauucuuuuuaugucucuguccuuggucuuuuauggaaacuccccuuauguaaaaacauagauggcauuaacagccuuaucauuuucacagauuauaguacuaucuuuucaguguugguaagguuggggcacccuggaaacaacuuaggucucucauuucuuccguuucauuaguauucaucucucaaaugauucucuacauauuccgucaugaucuaaaaugaauagcuuauaaaaacuaaaauauauucaaagcaaaauuuauuuuucagguaaaaugacuugagauuuaaaugcuuuguaaaaaugcuccaaauuuucuuuaaaagcaggcaauauuuuuaaaucaacuuuuauguugcuuccauuuccuguuuaacucuaugcuuaaaaauuaaaagaaagugacacauuagaggaauuauuuagcuaauacaagcaaaauuauuuauuggaggagauuuguuuuugacagcuauuuauauuuuuaauuuuaaaguuuucagauauuacaauuguuuauuucauuuugcauguuuugggauuaugguaacauccuuuugaaaaaaaaaauuuguugcauaagaaauauaucaacuacagaauauaucaacuacagaaaacuuaugaaauauaaaguggucaaauaaauauaaauaauacuuaagaaaaacugucauaauuccaacacccacaaauaauuaccauaagguuuccuucaccaaaaauuuuauagcacuauuucagagcuauuguaauaaauuuucuuuauaggagaaaauauaucauugucuguaauauuuggauuugguuuuuauauguuucaagcuaaauuuguaaagucagauacuaaggcacuuuauugucauuuucuggacaacuguuguguccuucaaauaguuauguucaaugccacaaauuccuagaggaaacugcaauuuuuuauuuuuuauuuuauguacagauuggagaagacuuccaagagagaugaugccaagaaauaaauguaaaaaagguacauugacuaauauaauaguaauucagguaggaaaagguuauuucuuacauucuguuaauauggauuugucaacccaaaguuauacucacuguucuuaaugcuuuucuuauuuugagccagacaagggaucucaugccuguaaucucagcauuucgggaggcugaggugggaggaucacuugagcccaggaguuugagaccagccugggcaacauagugagaacuugucucuacaaaaaguuaaaacaaguauuagccaagugugguggcaugcaccuguagucccagcuacuugggggucuaaggugggaggaucacuugagccaaagaggcagaggcugcaauuagccuaaacugcaccacugcacuuaagccuggaagacagagcaagacccugacacucugucuaggacacugacucucucccucucucuguccccccauguauguguguguguguguauauauaugcauuauaacuauuuugcuaaagcuuguuuuuuguuguuugucuuuuggguguuuuuuuucuuaguuguugccuuuucuuuguguaugucuuauuuuuuaauuuuuaaauguuuuaucuuuuuuuaaauuucuguguuuauuuuagauacagggguacaugugcagguuuguuacauugguauauugcacucagguagugaguguacuaccuaauagguaguuuguuaacucacuccaccccguccuccccucccgacuuuaguaguucacugugucuguuguucccauguuuauguccaugugugcucaguguuuagcgcccacuuauaagugagaacaugcaauauuugguuuucuguuccugcauuuauucacuuaggauuuuccuuuaguuauggaauuguggagcugcuaagaaagacuuuucaauuauuguagaccuuuucauuugcauaacugcagauuuuuuauuauacuggcuacauuauaaauuauuaacuaaaacauuuuaaaauugggaaaccaauaaaauggagcuuuauguuguauagaagaaugccaaagugaauguuuacaguuuguuuuucuuuaguaauuucauucaguaaauaguuaucuauuauugccagacauugugcugacaggaauaaaacugagcaaagugggaauaauccuuguccucauggagcuuguagucaaaugggguaaaaucacuaaagaaaaacacacuguccucauugggaaggguucuuugaggacauggaauuggaguugagauugaaggaugaauaggaguuuacugagacauaguugugggagaggaaguagggaaauaccagguuugugagagaaaaucagaaguucaguucaaagauguuacuuaugguuccuuugaaauauacaaauauaaauguuaaauauauucuuggauacaggggaauggaccucaaaauggagauagcagucauuaucagagauaugaucauugagaccaagagaaaggaugagauggucuagggcagaauuagauaauuagaagaaaggagagccuaacccugagcuuacaggaaugccaacauuuaaugggcugguagaggagauugaauggcaaagaagggaacuggaaagagagagggaggaggagaaccaggagagcagaguuacacaagguagucugguauuucggaagguggucaacaauguuaaaagauguuagacauugcugcuaagaggucagauaggacgaagacuggaaaauguucacucguuuuugacauguugguuauugugaccucagugagagcuuuuugaaagauucacugagguagaauccagauuggaauggcuuaaccgguaaauggagcuuaggaaauggagacagcuagcauagaugagucuucuuagaauuuugcuaugaagaaugaagagugaaaaaggaagguagucagagagguuaagaacagugggguuaucaacuaagagaagagaagagaaggaauuccuauuccccguuuuaacaccuuuauugagauauaauugacauacaauacaaugcacauauuugaaguacauacacaauuuacauuuuuugcacauguguauuuaaggcagaguauuuuuauuuuauuuuaaagauacaguauauaaucauauuuagcuugcauaaagaauauuuugaaauaugacaauuuaucuucugucuuuuauaccguugguuuuuauugggcaaauauauuauuuucauaauaaaauacaugugcaugaaugauacuggucauguccuagaggaucacacaucuguaguugacuuuaaagcugagaaaaauguguucauuuuggaagaguuaauguuuucaaauauguuaucccugggauuuuauacccacauuaaucaguaaaagcucccaaagugucaggauuuccauuuguuaauaaacaaagcaacaaugaaacuuucucauuuugcucuaguauuuuuuauuacauauuguguaauuuuuaugucuuguuucugauaagcuuguacuguccuuuauguuaagauguccuccauuaauuuacauggaaguaaacaguaacaacagagucaaaggcugaaaacaguuguuucuugaagaaccagcuacugccauguguuaaaagaaacuauucaaauauaugcagauacuuggccaaagauggaaaaaaaaaauaaguuuacuuaccuggccauauucucuaguaucccuucaacaaagguuuauguuaugaaauuaaauaauuugauaaaaaguucuuagaaaaagacuucaugauguaaguagaauacauucuuagcuaauguuuuuuggcauuaauauuauaauaauuuauugagaucuuguucauaugugaugcuauauuuuauguguuacaguucauauuaaacagucuuugcccucgagggggucagagaaaguuacccaucauuaaaucuaacuauuacuuuuguuugagaaaccucacuaauacauauguuugggagcucugagcucaguaauuccccaaggggcaauucaguauaacacaguaaauuguaauuccaucaguuaugggucaucuaccacaaucuaaaaauuuucuuuuguagguuaaauguuaaucuuuaacaaaauuacaucuuucugagccacauuuuccucuuacaaaguaauuucuaaguguuuagcuuuauuuuggaaaagagcuguaauacucuuugaccacaaugggacaauuuuguagccuaucauauugcuucgguaacugacuggcagaauuuauaugugaaauacuucucuagacccugcacuuucagaauagccucaaaaugcaauauuuuugauaggaguaaaaaaaauaauuauguagcccaaagccauuacaacauuuuauuucacuuacaugcuuuugaguuuucagauucauaugaugaguauauucaguuuauuuuaaucuuuauuccaaagauacuucuguguugcacugucaucucuuucaccauugguaaaugaacauauuugaaguacagacacuuuacauuuuuugcacauauauauuuaaggcagaaguauuuuuauuuuauuuuaaagauacaguauauaaucauaauuagcuugaaugcagaauuuugagauauggcaguuuaucuucugucuuuuauaccauugguuuuuauugggcaaauauuuucauaauaaaauacaugugcaugaaugauaccagucauguccuagaggaucacaaaucuguaguugacuuuaaagcugaaaggaauauuuauccugcacuuccuuuuuauuuuacacaccugcuaagauuccucugguuaaaaugaaguacacuuaccagugaaggagaagccagugcagguggauuugugggagccuuucacuauacucuugguacuucucuaucugaggcaacauuuuagcaguuuuggcccuaaugauauuaauugccaguaccaauguucagaacuaguaaaaaauauaguuaacuucagucuuaaaaaaaaaaauccuacuacgugauuaucauuuauucaucaucauuggaaaauuggugagguaugauuuguuuauucuuugagaaaauuaauuuacucugaaaacuaugugacugccuaggaugcaguagcacgaugcuggacagcauacgcaaagacaaggaaauauaauacagaguugcaguugcagaaaaauguguuaacugguaguuuuacuucagcaggcccaaaacccaaaaaggcaaaagacgcaggcaaaggcacaccacucacuaauacugaagauguguugaaaaaaauggagguaagguuuucuucuuacuauacaagugaacugaaaaaauguaaaagauccuaccucguuuugcucuguuucaaccuuucagcauucucuuacuuuuuaauaauguaaauuuggcagaagcgagcccaacauauaagguaacugggaagguuugaacuuugcaggcugggagauauggagggucuguccuguccuucguuaccacucaccuggccacuuaccucaccuucugucaccucuuucuuuuucacuguaucccccuuuccgcuuauauuugaaucaugcaggcagagagaaacaugaacaaguuuuaaaaagaguuacauauguaacucuuuuaaaaaccucucauuuuuccuccuguugguuaauauguacaguuuuaaugcuuuuuuuuuggucuuaaguauugaagacucuugagggaaaaauguauuuuauagaacuuauuuuuauagcuuucuuuaucuaaauauuucaaaaauaaaaaaauguagauucagaagguuaaagcacugaaaauuuuaaaaauuuaauuuuucaaaaauaaaaaauguaagauucagaaguuuaaaacacugaaaauuuucccuccuauuccugucccuagucauccaguucccuuccuauagacaaccaauguuacuaguuucuuaugucuuuuuucagaaguauuucauacauagcaaauacgagguuucuuuuucuuuuuaaagacagagauagcauauuacauucugcguuuucauuuuaucacuuaacugaauaccuuggaugugguuccauauaagucuguguagaguuaccucauccuucuuuuuuuuuuuuuggcugcacuauaaaaaugaacuguaauuuauuuaauuaauauccuacauaauuggauauauggacauuauguuucaucuaguguuuugcuguuauuaacaaugcugcaaugaauucauguuaaguaugucauuucaccuguguaggguagauuucuagaaguauuuggucaguacauaaaugugcacuguaugaaauggauagcuauuguuacauugcucuuuauggagguuauaccaauuuacuaccguuaucaaugcaugcauugucuugccuuggugaugaugaugaugacaguaacagcuaacacuuuauugaaacuuauucugugccagccuccuugaugagcucuuuacauauguuauguccauaagaguucauaacaacaaggagagguggauauuauuccuucuuuacagaugaggaagucaaggcuuuaaaauuuuuacuugccuggccaaguuggcacagcuauuugguaguggaaacucauauuuuuauuuuauuauuugaccaguacuggaguuagagacaacaugucugaaaaauaaagccagaguacugaugaaggagcagugauaacugucagguuuaacuauggcggaaugaugggaaugcaguucuagccaguuuguauugacugaacucagguucuggcuauucuaaaagcuuccuggagaaaacuugcuaagaugacaugugccguaaggaagauugaucuggaccucuggguuucuccguguaacaaacuguguuuccauauugucuacauuuaaacacaauuuucaggacacacacuggaaaaacuggaaauuuaaaucuagaaauaccaaugaguuuagaagagcaaaaguuguucccagaugacuuucuuauugcugauuuuuucagcaaaagcaguuccaaguuuuuuuuauaauagagcauucguggauggagagggagugacauacauucaaaucucaugauuaaugugugaguaauuagugguaaacuaauaucugagguuucuuauuucugcauaacaggaggcucuguaugguggcuguaaggcuguauaauauuuaaaccagaagaacugcucucuguccauaauugaacacuguuuucaguaucuuuauauuauucauuuuauucuuaaaucuguaaaguaguaaaguuagaugguuaaaucucaacaggagagaaaauggagacuaguaaguagaagagcugaaacuaguagcuuaaugcaaaaggaaugaagcaaugagacaauauauguggcuuugagaucaauuuuuauuaaaaaguugcauaaaucuacuuuuaaccuauuuuaugagucugauuuagaucugugugguggaaauaaagaugaggauuuuuuuuuuuaaagguauuugagguagcaauaauagaaauagagacuuccugguuccuauguggcacugaaugaauacuguauuuaaaaaguacuuuuggccaggcgccguggcucacgccuguaaucucagcacuuugggaggccgaggcggguggaucaugaggucaggagaucgagaccauccuggcuaacacagugaaaccccaucucuacuaaaaauucaaaaaaaauuagcugggcgugguagcaggcgccuguagucccaguuacucgggaggcugaggcaggagaaugaugugaaccugggagguggagcuugcagugagccgagaucguaccacugcccuccagccugggugacagagcaagacucccaucucaaaaaaaaaaaaaguacuuuuacauaacugguuuaaauaacuguguucuuaauuauaaaaauaaaauaauagcauguuuuuuagauauaguguguacccugcacagagcuaaauaaauauggcacuacaauuuccuauuaacuauacaacuuauugguugcaggucuuuuuacugugaucugauuaaaauaguaaaaaaauauaauauuaacauaccaucaaauauguguguguauaucuuauuauagaugcugcaaaagauccauaagcacgauuuucuuuacuugcacuuuuccaaagggauugccaguuggaaaaauugcacacaucauauuguaguaauaacucauauaagacaacauaugagucaguaucaagauaaaucaucuuaugucuguuaccuuggucuuauuuguucugccugaguggguuaagcagacaggaaagguggaguuugaauuuugauuagaaauugagccuaucuaauguagucucucuguugucuuugauuuccuuaaauucaaauuugaauuuaauuacaaggauuuuuaaagauaagcguuuaagaaccaguaaaggaauagcuaaguuguaguuacuccagauauaaaaucugcuuucucucuauauguaaucuacaaagcaaauaccuuauaauagagauggaguguuugcagauucaugcauuaguauuccaauuucuguuuaggaauaaucacauuuuagcugaggugacuuaugccuuaauuaugcguauuaauaugugaaauuauugacuccuggaaaacuugugaaauucuaucauaugugcaaauugagcauaguacaauuuagugaacagauagugacaguaaugaaaauaagucacuuuuuauuaaaugaaaaaaauuguugguagucauaauagaaauacaaagauguaauuuuaaaguuaauuuuguguacuauucccugaugguuccacuuguggauaagugggacucucauggaaucaaagcuuuccuaacucugcaucucucuuuugucuucucuuuuagaauuccuaauaauugcuaguauugacugugauuugaguuuuaauuucucucuuucuucucaaucugccagauauauuaagaaacaagaauuccuggcaacaggaaguaaauaaugagagagaaaaaagauaaagacacagauaaaaugcaacuaggauaaucuaacccaggaugacuugcuauuauaauaauaguauuaaauggccucauguauaaagugaaacauagacauuuugagauaauacuauuaccuuauuuuuccccuuuuauguuagaaggaaaacaaaauaacauucuaaaaguucuccauaaacuaagucaccucaaauauuuuagaaggagguaagauagaccaccagguacuguggcucaugccuguaaucccagcacuuugggaggcuaaggugggcagaucucuugagaccagcaguuugagaccagcauagccaacauggagaaacccugucucuacuaaaaaaauuagccaggcuuggugguaugcaccuguagucccagcuacgcaggaagcucaagcaggagaaucacuugaacccaggagaaggagguugcugugagccgagaucguggcacugcacuccagccugggugacagagcgagacuuucucucaaaaaagaagguaggagauaaauuauaaaaaauaaagcauugugcauuagagcugauaagcccaauauuaaucugaaacccaauuauuaaguaacaaaaucaaagaaaaugcugguuuaguggugagacaguaaauuccuucuuucuugaguugacucauaguuuccuaggugguagccaggagguggugguaagaugggaguagaauaaggugauagauaacuguucccuuaaggcuaagcagggaagucagcagucuagugguuuccauacaaauuaaugaaacucacuuauaccaggaauuggaaaaaagaggugauggugaaaaaucagaugaggaaaaugaagagaaagaaggaagcaaagagaaaaguaaagaaggugaugaugacgaugacgaugaugccgcagaacaggaggaauaugaugaagaagagcaagaagagguaaugguucauuuggggaugguagcaaaauuaauaagguuuaucuaauaaggaaucagauauagaguauguauugaaaucaauaaacagaaaccaagaugaugggaaccagaaguauauuauuaucaauggcaucgauuccuugcuaucaagagaacuuccuugcuaucgagagaacuauuauagcauugaaauuauaaugaugucaaauugaauauaggaaauaaaaaugauuggcaacuuuguaaguauaaaucugcaaguuaaggagauugaucagauuagugcaguuaagauuuaacaacauaaaaauuuaagucagcaauucagguaacggagggcuuaaccaccuaggucuagaggagaaucccugcaguguguuucaaauuccaaagugcauguggauacuaucagagaagauugauaauuuaaccucagguaucuggcugagucaggacucuguguuuuccauuugggaugucuaacuuuuagaaugaaaugcacauaguacauuucagaauuagcuggagucaaucagguauuuuuaguaggguaacuuugcagaccacagccucuucgggacuuuguagacaccucagaccguaacccuagguggagaguuucuucuccauucuggugaccuuugucuucauuccauuucagccucuuauaccacauucucaaauuuugcuucucuggaaacuuccaacuaugaaaucuuuacuauaauuauuuugcauuaaauuugguauucuuuugaaauuuguauuaguauaaacagagaaguguggauacauuuuuuaucuguuuccaaguggcuagccagcugcuaaccucauuucuuaauuugcuuuccucguugauuuugaaauucuucugguaucagcuauuagauucucauuucuacuucuguucucuguuccauugaucuauuuugaaccaacacuaagcuguugcaaguaguagaagcuucugauuauuuguuaauguugguaggguaugucuuccuuccuauucuuuuuucacaauuuuccugaauauucugucuauucuuucagauacauuuuaagucuaaacauuuaaaaauuaaauaugucacauuugugguagaucacauuugucuccagccuucuuuucagaucauucauguuuuuauuuccauugcucucugacaugauugaaacugucaguacuucugaucaucucuuuccccuuuauugguucucuguuuuaauuuucuuuucuaagaaacuuagacccuugcucgcccuucaucuucuuuuuugccauuauugucucuuguccucccagcgcacacacuagaccaaagccaacuuugaucauuuccauucucuaccuauuuucccuuucaaaucugaccuauugagcauuucuugggaaucacagaaauugaugccccucaaaaaacacuagccccauuuugcuggauaacauguuuucuguuuuuaagucagcucucuacagcaauuauuuuugaucaacuucuuucuucuuauuucccuuuguuuacuaccuuuucuuucacucuuagcaggugauaauaccuucauacgggaaaugaagucaucaagaggaaacucuauuaaauuucauguccucugccuucaaacucagugucuuccuuccuccuccucuuuuuuuuuuuaaucaagggaggaaauccccuuuauccuauuuggggcuaacggcccuauccuuuuuuggaaccauaguccuccagucauuucccuuuccauauuuuuaaccucuuuuucugcuugucucuuccauucaugaauguucauuucccauuguaaaacauguucauuucccauuguaaaauauguuguccacauucucccucaugccaucucuugaaaagcuucuuuagcugucaucaccccucccccucccccaccauuagcucuuuucaaucuuaguuucaccuccauccuauucaaauaauugcuuuugacaaauagaaguagcuuaaagaaagaaauuauugcuaccacgcucaccauagacaaauuuuagccuuuaugucacuuaacuuuuuugcagcauuuaacacuucugacagcucuauuauuaaaauauuauuuccuggccaagcgcaguggcucacucuguaaucccagcacuuugggaggccaaggcggguggaucacgaggucaggaguucaagacaagccuugccaacauggugaaacccugucucuacuagaaauaaaaaauuagccaggcgugguggcgggugccuguaaucccaacuacuugggaggcugaggcaggagaaucacuugaacccagaaagcagaggucgcagugagcugagaucgugccacugcacuccagccugggcaacauauauauauuuaugauuuccuuuauuuaaauucaacaauuuacagcaauuauaugcaucuucuauaugccaggcauugugcuaauugccaagucuuagacaaacaugguugcuucccuuaauuuuuguuacauaaugcuuuucguuuuucuccuauuucugguacauuuuuauggucucuggaguucuuucuagucuuuaaaugucaguauucuucagggcucuucccucgggcuucuuuuucuugcuguaaucucucugauugcaucccuccccauaguuacccuguauaaacauguaacuccucaguucuuuuucauucaaccuauaguaaguguacacuaaguauaugcuuggaauuguacuaggcaaugggaauaugaagauaagauacaguucuucucucagggaaauuacuagagagacaaaaaagguaacaguuaauauacagugaauaaugcugugauacaguaguaccggaugcuauagcggcauauaagagaugcugugggcacaccaaagucuauuuuaggcauaucaaagaugauauuucaaagaagacaauuuaggugaucugaagagcuaaucagaucaagauaggaacauggaauggaguggacacuugcagggagaaaaaagaacauggagagaggcuugcaggugaugggaguguagcuucuuaauuuaacugaccagauaaaucgguauggcgggacuagaggguguuaagugggcuuguguugagagaugaagcuggagagaugagcaggucauuaaggacuuugaaugucaagcugagaaauuugacuuuauccugaguacuguggggagcauugagggguuuuaaacaguggaaugguauaaucauguuuauauuuuagaaagcucaguugcuuugaauggaagagccaaguuugggucauauuugaaagcuuauugcuguaaaccagugguuuucaauacucuugaaaggauauuugguagugucuggagauauauuugguugucacacugccauggggguaguagggugguggugcuauagguucuaguuuguguggucaauacucuagacaagacuggcauuugcaaugcucuguugacaaugucugcuugcacugaguucaggaucaagaccauccuggcuaacacggugaaaccccgucucuacuaaaaauacaaaaaauuagccgggcgugguggcaggcgccuguagucccggcuacucgggaggcugaggcaggagaauggcgugaaccagggaggcagagcuuucagugagccgagaucgcgccacugcacuccagccugggugacaagagugagacugcgucucaaagaaaaaaaaaaaagauuacuaacgucacacaauuaccaaauuugaaucacuuaaacagaacuuggaggagguacucaugucuaaaacacaagugacauaugcuugauuuggaauacuagaguaucccuuccuuauucaucuccacuuuauguacaaaucggcuuacuuuuauuucuacacaaguguucuugccaaaggucuccuuuacaaugagaccucauuugaacucucaaccaugccacccuccccugguacacaggccccaagcuucacccaggugucuaaauauugccaaauuuuuuuggcaccagaaaagccaggccaacuuuccagagaugggaauggucuuagcugaaugcagaaacuuaaaguaucuagggaagaaaaaguaaugagauaacuaucuaaagaaugcauauacagugaauaaugcauguuaccuuucuugcauuauguaaauauauuaaaaaucccacuauccagauuuaaaaaaaaaaaaaaacuuuggaaaaaaauuaguaaaauugauaggagacuuucuuuugagaguagucuguauuucuuacuauagauaguagagauguggacauuaauuucuuauuauagcagaucucaaucaugugcaaaaauguagugacuaguaaaagaaacacccauggucuuaucacucagcuuuaacaauggucaauucauagcuaaucuuucaaccacucauucaucuacccaaucccucccuguccacccaucccauuccccgugccccaugugccuuggauuccaaagaaaauccuaggcaucguaucauuucauccacaaauaugucaguauggauucaaaaauaagggcucuuuaacaacaucacuguaucauuauaacaccccauacaaugaaauauaauuccuuaauuucaucaaauaucuggccaguauugaauuuucuugguugucucaaaaaguuuguuuguuccaaacagaauccaaauacaauccauacauugcaacugauuaauaacucuuagguuuaauuuauauccaaaguggauuuuugauuguaagauacuggaggcccggaaaaauaaauaagaaaguaauauuugaauuuuugauagaaagcacagauauuuucugaguuauuugcauggaugauagucuuauucagccacaagaaaaagaaacuaagagguccuagauagaauauaauauaggcaucuuuuggauuugguuugguaucaugccuuuuuuuuuuuuuuuaauaggaaguaaaagucuuucuggcuuaugcuuaguuauguuuuaugacuaaaaaucucaguacugguguagucuaauggauguuaauguaaacuggcuuuuuuucuugucugugcauuuuuuggguaaguguuuagugguuuagcuaacuaaacuauguaucaucccaguaagcuguaauguguuaguagcuauauuauccuauugagaugguaugggcaacccuucauguucucuuagcuaguuagugccugacaagaguggaaggugguggucuuaaggaagaaagcggcacagguaaacacaagugaaaacuguuguguuuuugaagcagauaaaaagcagagacuuuuaggccuggaauauuuucuuacuacucauucauuuuaacguuuacaaaggaauauaucauuucacuuaggaaaaugacuacauuaauucauacuuugaagauggagaugauuuuggcgcagacagugaugacaacauggaugaggcaaccuauuaggcaugaaauuuuucaaaaaauauuuuuaugaugcagcuucugaacauuuggacagacuugauuuguauuuuauuucugauaaggaauaaguacuuguuucuguuguuuuggacaaauaguuguuaccaaaauauucaaaaccacuuugaguuuacauacuaguuaccuuaaaaauuauucccugacacucugacauuccuucuaaacaccucugccaucucucuuauguacucucauggguuuuuuuguaugauuugaauaugaaugugccuaaagaauuuuugcucucuuaaucuauguauacauacuugaacaaaucauucuugcuuaacugcugaucuuuuguaaaacuauugcuagucauaauggauuucuauaaccugaaaguugauauaauacagcacguggagcacuuuaaaaacaaagaaacuugaaaauaauuuuauuuuuuaccuuuacaugguguguucuagacuacugcauuaugacuacauaaaccuaccugagcucuuacaaguacagaauugugagacagagguuuugugauggaaaacauacacauagggaaaaauaccaaacugagcaauauaaauuucacagcucacaucuuagccaguacaaagaaacuuucacauggggugaauauuauaauacuugaauuugagacuuaauacuguauaugaauuaaucaucccacuguaauaacugacaucuucaaauaguugggcuuaugaaaaauuugacuaagacauuuuauuuuauacuuuauguaaaugugaaauaaguucuggucauauaaauauguagaaugcaugugugugaacucuaugaagugaagugugguggccuuuuauguuucagaguacucaaguguacaauugauuuauauaaaaaugcaaaaugaacucaggucauuuugaaauuaauauuaauauuuuuguuguuuaacuuuaaagcuagcuccccuaacuuuauauauuuuuugggaaaaaauaccuaaaaaccucagccuacaaagacucucagaaaugccaaagauuuucaaggaaauucauauuauauauuucaaaaaugauuuaucaauguuaucuaccaaaagaaauaauuuuauuuuuccccuuuggggagauauuauccucuaauaugagaaucagaucccuagauucuauuucuaccuauacuauuaaacucaaccuugaaccugagcuugguuguuucugugccuuaguuucuccacucguaaacaauuuccuauaaaaauuguuuaaacaccaaccaaaauuuaccauauguauucauucucuugccuuaaagaucacuucuuaacuuacauuuggcucucacccucuaaaaauuuguaguuuggagaguaacugaaagcacaauuuuaagaaacauguuuuccucacaaaauauauuguaaucugauuuuccuaucuuguauucaugcagaaaauuggagaaaauguguauugucuugugccauucugcaauaugaauuucucaggaaaaagauguuucaauggcaauacuuucuuaaauaauucaagaugggugugaggaccuaucuuauuaguuuagugcuguguuaaccauuugugaauuacuucuuguuuaaaggaaguugucaaaaaauuuuaagauucuaaauggaauacacgaauaaaguaagccuuagaauagaaaccucacaaaaaguugucauuugcgguugauaauuaacauagguguuuuauucucucaacuccuuaguaccagagccaaauacaauuuaguuuucagaaaucuuaucaauauuguucuauuuaccuacuuauaaaucugcagauaaccacuugaaccaggcaaauacacugaagauaaagguuauuucuuuuuuuagcuuugaauuugucaugaccauuuuagucuugcagauagcagggcagccccuuggggcaaggauuuacucugggagguaccguuaagagccuucuuucccccuuugaaagauccuuuuacaauguuaaaguauacuaguugcaagaacaagcaggauuugcagguugcuuuaccagcaugagucucauuuuucuggcuuaaaaucugggacugugaaauuauuccauaggaaagugaauguuauuuugcagaauuagccucuuacauaaaaguauuuguugaagugucuuuaaaauugcuaucaugagcaaaacugguugcuguaaugcuuguuuuucuguauuuauuuacacauuaaauucuuacaaaacaaaauguguucguuuguuuuauaguaagauguuuuauuuugaacuuauuuaaauguuuauuuguuagagaaaacuaauuuguuaauauagaucuuaacuaguaacuauuaagcagggauguuuguuccaaauauucuugaauaaacaaucaccacaaacaa

SEQ ID NO: 192443 - RNA, 16566 nt, Homo sapiens
caacccgcgaggccccacacuuucugcgccagcugggagugcgcgcccugcagagccagugggugggcgguucuagcucuucccacccucacugcgggccucugcugucacacgcccgggguggcgaaacggucgccaccugagucuccauucugcugcaguggccccugcguuaaagcucucucguggugcggcugccgaggcugcgguagcuccugcgcccccgugcugguggcgcagccucugcuugcugccgaccuggcggaagggugcgggagcgcacgcuacgggcagcgucggucugcguccuuccuccuccuauuccgacccccgcaucccacgcccccgccucgcucuacgccuccucccuggcugcaggcagaccgcuucacacagccgcagugcccuguguguggacagccugugggagacucgcacgcccacacucaccccgccuggcugcaccccugcccagcaugucggcgcucgagugguacgcccacaagucucuaggcgaugguaucuucuggauucaagaacguuucuacgagucgggcaaccgugccaacaucuggcuggugcgcggcuccgagcaggacguggugaucgauacaggccuggggcugcgcagccucccggaguaccuguacuccuccggccucuugcaggaccgagaggccaaagaggacgcggcgcgccggccacugcuugccguggccacccacgugcacuucgaccacuccggcggccucuaccaguucgaccgcguggcagugcaccacgccgaggccgaggcgcuggcucgcggggacaacuuugagaccgugaccuggcuuuccgauagcgagguggugcggacgcccagccccggcuggagggccagacaguuccggguacaggcggugcagcccacccucauccugcaggaugguaaugggcccccgcgggcgcgcgcucucguuaagggaggguauugggaagagacuguccgagugccgcauguugcagacuugcguggccauaaaggggauuauuuuggcaccucgcagagccacuucuguuucacccuucccugaguaaaaacccacuugaccagagucaaggccaucacagccuucccugccagagaccagcucuggcaucguguagagauucugaguacuccuuugaaagccggcaccacccccucccuagccacuuuccugcaucggcuguagcaguaacacuacaaagacuugugacugacuagggauuucucauucuuucccuaagcaccugcccgacauuuccaggagcuuucguagugagcagacuuuuaaggaaugaccccucacggagagugcaugucaugaucugugcuuuugagaauugcagacuucaucagcuugguccccaccggguaugggcaguucccaccuguagccuuagagagucaucagaccagugauuccaauccgcuaaugcgauuggaaaccuuucagauagguuucuguucuugauguugccucacgauugcaaaagcuuaauaguaaucauaaacguagaauaugucugagucuuacuuuaugacagauauuugguccgguugaaagcaaagccugagaaagaucaauaaggaaguaauuuucgguagagguaaauuauguggacuaaugcauagguagccaugguccucuuuggcucugugaaagacaaguauggaauucagagagaaauucauggaaugaaaauaaauagggccucagcccauucucccuacguagggacuuaaauaauugagcuaauucgccacaucagcaauauuugguauauuaguuuucuauuuucuuuuuaaaauacuuuugauuucauuuuaucuucacaacacauuuaaagugaggccacugaccccccaguuaaauggcuugccugagccagaucaugauaaaagcuaggauaugaaucuaggcacaauagaucaaggcaugcagaacauacauaaauccugccucauaaauauaugaugauuuugaguagaaugugaaaggccccuucuuuccuuuagcgugagaucauuuuaauuaccaaugugguauauuaaaacgugccucuauaugguagaaaaauucaguugcugcaguauaaugaagcucacuuuaugaccaaacaauauggcaaauaaugaaauauuuuacaaaaaucaguuuaucucacagaugacaucuucauuugagauauuuuaaaaauugcaauauuguacugcuuaucggugcuaaaaaaaaaauugcaagauucuguaccucacacccaccgaacaagucuucauuaaaguuuuaaaucuaaauuuaaaaaaaaaaacugauuuagauaagagucuuacauuaucugacaauaugagaugaaaguacauguacauuaaauuuuaauucacauuaaagucacaccuaauuacuguauuucuugauaaaaauggguacuuuuagagguaacauuuccaugcaguugauagguauucagacuaaauucugacacccggaucaaaaauguuuacauugguauuaaaauauacuuaaauuguugaaaagaauaaauuacuuuugaaauuuacuuuugauucugugucagcaaugggaaaucaaaggugagagaaugauagggguuuuuuauagaugaagaaagaacccaugcagggcugaguaucaugugugaggucacauaccccaucucggaaagagcugggacuagaacccagguuuccaguugaugguagaaucccaacauuuuuggagcugaaaggggccugcaaacuacuuguguggugcuuuaagccuuuaaaagggugaaaagaaagcuuaauguuuaccaaacacuuugaaggugauaguacuguguuauccguguuaucaaaaguuguuuuucauuaggagcuggaugccccacccucucagguagugucuaauuuccucucuucucaagaauauuaauuucccguaucuucugaaugauguggccugcuaacuugcuguuaacauaauccaggugccugggaggauacauaaaauauuuguauuaaaaauuuguauacaguuacacacaugaacagcauaaagucuucauugcuuugguagaaugcaaggagcugaaaucauuuauuacauuuccuuuaaugaauugaugaucacuugucauggagaagcauaaaucugugcacuguaucucuaacccaaaagccgacuuguaaaugagggacaaggagagaauagccauaucuuccagugcauuauucuggauaaaaaagcaacucgcccuacuaauagugaaaugguuaucuuccucuaagauagcagcagaccuuaaauugacauaguacauaccucucgagugggcauacaucauuuugcccauuuuucacuauagucaagugauacaaaguucuggcauugugaucccuauuacauacauguuuaaaccauaugcccagugucaccaagauauuaucucagaggagugguuucagguggacuuaagucauuugcagaggcuaaaacagguuguaggaaggugguggauugaacagacacaucuaauuuggcucucuuccgaagcacuguugaacugugaaaaaaucgugauuucaauuuaaauccccauuggcggggggaacuguuuuggaugcuagaaaguagauguggugacuaaguuaacaguuuuauacuaugccagcaaagggaaauuaagagccaauucaguuugcaccgcugaagccuuaaaaaacucaggaauuugcaauaggcaguaguaccucaguggcggcaaagggaagaguaagcagaauuucuugaaaaccuuuuaagaagcucuuaaaacucuagugaaugccccucccucucccauccaauuaguuuauucucuggggauaguaaaacaaaggaguuucuugauugaaggaugccaaauuacuguugagcuuaagggcucaguauggaaaacaggagaaagaaagcgugugugugugugugugugugugugugugcgcgcgcgcuaguuuucuagaaggaugagagacaggagaaagaguguguguguguucuacuaguuuccuagaaggaugagagccaggccuuuccccacccagguaggaaauuagaaaaauguuaucuagggaaucugccuccuagaagaaagacuaagauaccaauguagaggaauaccuaagaaauccuggccucuuucucuacugugaagccuuggucaccaggccccaugcaugugcugcaagcagccuucuuguccccccuucuuuuuuuuaauugauaccuaauaguuguaauuacuuaugggguacgugugauauuuugauaaacgcauacaauguaaugaucagaucagguuauuuagaauauccaucaccucaaacauuuaucauuucuuugugucagaaacauuccaaaucuucuagcuauuuugaaacaugcaauaaauccuuguuaacucuagucuaucaaacacuggaacuuacuucuuuuaucuaacuguauuuuuguaccuauuaaccaaucucuucauucccuuccccccuacccuuuccagccucugguaaccaccauacuagcacuaccucccacauaugaguauaaacgugggauauuugucauuuugugccuggcuuauuucacuuaacauaaugcccuccaguuccauccauguugcugcaaaugacaggauuucauuauuuuuuaugagugaauaauuccacuguguauauuuucccacauugucuuuauccauucaucuguugauggacacuuagguuaauuccacaucuuggcuauugugaauauugcugcaauaaacaugggaaugcaguuaucucuuuaguauucugauuuccuuucuuuuggauguacauacccagcagugggauugcuaggucguaugguaguucuauuuucaguuuguugaggaaccuccauaccauuuuccguaguugcuguacuaauuuacauccccacuaacaggguacaagcauuccccuuucuccacauccuugucagcaucuguuauuuucugucuuuuugacaauagccauuuuuacucaugccccccaacucuuaaauaggcaaccaagcauuauaaaaaaacagaaaauucucuaacaugagaucagcuauuaaaacaaacagcauaaagcaauuugagaguggggaacuaucaucaauaucaucagggggauaagacaagcuauugcauucaagauauccaagagucaguaaggaugcuuuaaaaauaaauagaacaauauucaccaaaaaaaaaaaacucuuagaauuuaaaacaucagaaauuauguagcagcaggucuggaagauaaaguugaaaaacuuacuaaagaucaguacaggaaaaugggaacuaggagagaaaaagacuaaaauaaguaggaggaccaguuuggaaaauccagccuuagaauaauggaugcagagauaggacagagaaggugaaagaaaagaaauaguaggguggcugggcacaguggcucaugucuguaaucccaauaauuugaaaggccgaggagggcggaucaccugaggucaagaguucaagaccagccuggccaacauagugaaaccccgucucuacuaaaaauacaaaaauuagcugggugugguguugcaugccuguaaucccagcuacucgggaggcugaucuugguuauuucuuuuuuucuccuggguuuggguuuggauuguucuuauauuuucuaguuccaugaggugugaccuuagauugccuauuuaugcucuuucagacuuuuugauguaggcauuuaaugcuaugaacuuuccucuuagcacugcuuuugccguaucccagagguuuugauagguugugugucacuauuaguguucaguucaaagaauuuuuaaauuuccauuuugauuucauuguugacccaaugaucauucaagagcagguuauuuaauuucuauauauuugcaugguuuugaggguuucuuuuggaguugauuuccaauuuuauuccacuguggucugagagaacacuugauacaauuucaauuuucuuaaauuuacugagucuuguuuuguggccuaucauauggucuaucuuggagaauguuccaugugcugaugaauagaauguaagaaaucaaaaacaugauacaagauaugaaagguaaauucuucagugaaauagauagcauaaauaaaaaacaguuacaacaucuggaaaucaaggacauauuuagagaaauucaaaaugcacuggaaagucucagcaauagaaucaaacaagcagaagaaagaaccucagagcucaaagacauggcuuuugaauuaacccaauccgucaaagacgaagaaaaaggaauuaaaaaaaaaugaacaaggccuccaagaaguccggggcuacguuaaauguccaagucuaagaacaauugguguucccaaggaagaagauaaaucuaaaaguuuggaaaacuuauuugaaggaauaaucgaggaaaacuuacccagccuugcuagagaucuagacauccaaauacaagaagcucaaagaacaccugagaaauuagucacaaaaagaucaucaccuaggcacauagucauuauguuaucuaaagucaagaugaaaggaaagaaucuuaagagcugugagaaaaaagcaucauguaaccuguaaaggaaaaccuaucuaacagcagaaacucuacaagcuagaagggauugggguccuauuuuuagccuucuuaaacaaaacaauuaucagccaauaauuuuguauccagugaaacuacacuucauaaaugaaagaaagauacagucuuuucuagacaaacaaaugcugagggaauucacugcuaccaagccaucacuacaagaacugauaaaaggagcucuaaaucaugaaagaaaacuuugaaauacaacaaaauagaaucuuccuuaaagcauaaaccucacaguaccuauauaacaucuaacaauaacaauguaaaaaacaaacaaaccgccccccccaaaaaaagaagguauucaggcaacaaauagcgugaugaauagaauaguaugucgcaucucaauacuaacauugaauguaaauggccuaaaugcuccacuuaaaagauauagaaugacagaauggauaagaauucaccaaccaaguuucugcugucuucaggaaacucaccuaacacauaaagacucacaugaacuuaagguaaaaggguagagaaagauuuuccaugcauauggacaccaaagguaagcaggcuuauaucacacaaaacaaaauguaaagcaacagcaguuaaagaagacaaaaagaggaacauauagugauaaaaggacuaguccaacaggaaaauaucacaauucuaaauauauaugcaccuaacacuggagcucccaaauguauaaaacaauuucuacuagacauaagaaaugagauagaugguaacacaauaauacugggggacuuuaauacuccacuugucgacaguacuagacaggucaucaagauggaaagucaacaaagaaacaauggacuuaaacuauacccuagaacaaauggacuuaauagauauuuacagaacauucuacccaacaacuacauuuuuuuauuuuuuacuuuuuugagauggagucucucucuugcccaggcugaagugcaauggugcaaucucacugcagccucugccucccaaguucaagcgauucuccugccucagccuccugaguagcuggaauuacaggcaugcaccaccaccucuggugaauuuuguguuuuugguagagauggggucucaccauguuggccagggugaucucgaacuccugaccucaagugauccaccagcuucagccuuccaaauugcugguauuacaggcaugagccagugcgcccagcucacaucuuuuucaacacuugguuuugucaauccuuuucaauuuagccauucuagugaguguguagugguacuugauugugauuuaauuugcauucacuaaaaacuaaugauguugagcaucuuuuugguacuuauuugcuaaucagauauccacuuuauuaaaugguauauuaaaaucuuuuuuaaaaauucagcuuuuuuauuauugaguuaugcaagcucuauauauucugaauacaagauuuuaucagauguacauuuugcaaauaccuucucccaaugugugcccugccuuuucauucuuaauggugucuuuuuaagcaagaaaguuuauaacuugaaguccaguuagcaauuuuugucucguguuuuaugauuguugugucauauuuaagagcucuaugucuagcccaaggucacaaaaauguuccccuaauuuuucucuagaagcucccauauuuagguuuaugacuuauuuucaguuaauuucugugaauauuugugaaguaaggguugagagguucucgauucuuauuuguuugucugcaaauggauauacaaaguaucccaguccagucugucaaaaagacugucauuuuauccguugaauuaucuuguuugacuuuugucaaauaucuauugacaauauugugucuacuuucagacucucuguuauaucgauuaugucuauuuagucaguaacacaauauuuugauuacuguagcuuuauuguacacuugaucuuagccaaaagacugagaagugauguuuuauuguaacucuugaaauuaguauacgucuucuuacuguguuccucuuuuucauaauuguauuggcuauucuaggucauuugcauuuccacgugaaauuuagagucagauuuucaguuucuucgaaaaaagaucaagauuuugauugagauuauguugaauuuuuacuggccauuacaguagccacuagccauguauggcuaucaaauuuaaauuaagauuaccggauauggugacucaccuguaaucccagcuacuuaggaggcugaggcuggaggaucauuuaaggccaggaguauaagacuagccuaggcaacaaagcgagauccugucucuagaaaaaguuuuuaaguuagcugggcuggugucauauaccuguagucccagcuacuuggaaggaucccuugagcccaggaguucagggguuacagugagcuauaagcgggccacugcacuuuagccugagugacagagauuccaucucuuuaaaaaaauaauuaagauugguuagaauuaaaauuuuaauuccuuaauuguacuagcuuuauuucaagcaccauuagccacaccauauugaacaguauugagaaccaacauuucaaucauugcagaaaguuuuauuaggcaguguagcuauuggaaaaauuggguuacauuaccaucauagcaauauugagccuuagugauauugagacagucaguaagcauagccuaucucuccuuuuauugaggucuucuuuaauuucucuugacaguguuuuuguaguuuucauuauacaguguucauauauuacaaaacaucuuuugucaaauuuuuucccaaguauuuuauucuuuuugaugcuauuuugagucaaaugucuuaaaauucauuuuugauaguuacuugaagcauauagaaauauaguuuaucuuuguauguugaucugguauccuguaacauugguaaacuuuuuaguucucuagcuuuuuccuacuuaggauuuucuguauguaagauuaugucuaaauaaagacagauuuucuuuucuaaucugugagaccuuacucucuuuuucuuggcuuauuacacugucuaggaucuucaguauaauguugaauagaaaugguaagagcagacauccuugccuuguuaucuuaggagacuuucuauucaaagagguauuaccuauagauguucauaagugacuuuuaucaaguucaggaccuuccccaacuauuccuaguuugcuggaaguuuuuaucaugaaugagaauuggauuuugucauaugcuuuuuauguaucuauugagauaaucauauggcuuucuccuuuauuaauacaguauauuacauuaauuuauuuucacuaguuaaaccaaacuuaauauuucuggaauaaacuucacuuggucauuuuccuauuuauaaguugcuggauuugauuugccaauauuuugucaauaauuuuaagauugcauucauuagguauauuuguguauaggcuuuuuuuuguuuuguuugaaagagucucccuuuguuguucaggccggagugcaauggcgccaucauagaucucugcagccucaaauuucugggcucaagcaauccuucuaccucagcuuccugaguaacugggacuacaggcacaaaacacccuacuuggcuuuuuaaauuauuauuuauuuuuaauuuuuauagaaauggaggucucacuauuuugccgaggcuggucucaaacuccuggccucaagcaguccucccacauguugccaaagugcugggauuacaggagugagcuaccgcaccaggccugauguuguuguuauuuuaauauauugucuuugucuggcuuuuaugaggguaauaacugaguuagauuucucaucuguauucugaaagucuuuauauggguugaaauuauuauaggguugaaauugucccguuauaaaaugauugacagaauugaucaaugaagccuuugagcccagacuuuucuuuguggggagacuuuaaauuguuaaucaauuuauuugcuugauauacauuuauuuagacuucauuucuucuuggaucacuuuugauaauuugucucuuuuuaagaauauguucauuucaaauaaguugucaaauuuguuggcuuaaaauuguucauaauauucccuuauucuccuuuuaauuucuucagggucuguagugauguuccuucuuuaauuccuauuuuagcaaguuguaucuucucuaauuuuuucuugauuugucuagcuaaagguguaucaauuuuguuguaguuuucaaauaaacaacuguugguuucaucuguuuuuuucuguugguauuuguauucauuuauuuuugcucugcccuuuauuauuucuauuaacacuuacuuuguguuugauuuguucuucuuuuccuaacuucuuaggauaguaauuugauuguugauuuuaaacauuuaauccuuuauaaaauaagcauuuaaagcaauacguuuucuucuaaguacugcuucagcuguauucuauacauuuugauauguuuugauuuuguuuucauucauucaaaauauuuuuauauuucccuuugauuucuucuuugauccauaaacaauguagaaguuugcuguuugcuuuacauauauuugaauauugcccauauuuauuuuuguucuuccuaauuuguuauuuuuugucuauuaaaaacacauaauaagguugggcgcaguagcucaugccugcaaucccagcacuuugggaggccagggagggaggaucgcuugaggccagccuuggcaacauggcaaccagccuggccaacauggcgaaacccugucucuacuaaaaauauaaaaauuagccaggcgugauggcacacgccuguaauuccagcuacucagcuggcugaggcacaagaauuguuugaaccuggaaggcagagguugcagugagccaagauugcgccacugcacuccagccggggcgagagagcaaaacucugucucagaaaaaacaaacaaaaagacuacauguuaucaauuuucuguucauuuuguuauuucuaauuuaauuauguuguaggcagagaacauacuuuguaugauuuuauuccuuuuacauuuauugauucuugcuuuauggccuagcuuuauagccuguugaauauuucaacuacaguugaaaagaauguguacuuugcuguuuuggaguaaaguguuuuauuuuugucaggucaaguugguugauaagaguuguucaggucuuccauauccuuauugauuuucuauuuacuuauuuuaugaauuacacagagaagaauauugaacucuccaaguaucauuguugaauuguuuauuguuuguuuguuuuugcuucauguauuuuuggugauguuuuaugugcauguacauuuauaauuguuauuuaucaauguauugauuuaauguacauucucauaaaauuacuucuuuuuaguaauauucuucauguaaaaaucaauuuugucuuauauuaauauuagcugcccuaguucucuuaacaguaauauuuaauaugguuaagcuuuucaaccuauuugugucuuuggucuuauaguuucuuucuuguaggcugcauauaucuugauuuuuaauccagucugacaaucucugccuuuuuauguuuaccaaauccugauuauuacaccauuuugauuccuuuauuauuuuuuagcuauauauuuuuaaauuuuuuccuguguaugugcuugcacuagagauuacauuaugaaucuuuuaauuuaccaugauuuacuucaaguucauacuaauuuaauuccagugaaacagagcaauuuuccacccauguugcuccauuuccucucugcugucgguaacugaagucugagauuuuacccuauuugcaaguuagccugccagaguuuaauguauucugacagaagacuugagguuccugggucagagauuaaggagauuauuacucacauauuagagcaucaugauuuauaucaauuccucaagcccuaauucugacagggugauacaagaggcaaaauacaauaaaauucccuagagcaacauucauuaauugugucaacaggauacugguaccauagaugugcugaaaaguaaaaguuucaugaucaaauaaguuugagaaauuguacaacuauaucuacuuuguauauauccacaguauacauucauauaauaaaagcucaaagaagucuuucugaaaagaaagcugcuuaauuuucuuuaaagugagaguuccucaaauuauuugaccacagaacuaccuccuuuucauuuauguaucaugauagccuguagaaguaguguuccacauuacuugcuuuggcaaacacuggucuagcaaacaauaggaaugaacuauaggcagcuuauuuuuaaaucaucauuaagaaauacaguauuuaugaaauaaagugucauccuucccaauuucuuuggaagcauauaaugcucuaguaugcuuuacaugcuaagucaaguauacaacauguuuaucuguaaacucuguuuccauuuguaggggaugugaucaaccuuggugacagacagcucacuguuaugcacaugccaggucacuccaggggcaguauuugcuuacaugacaaagaccgaaagauucucuucaguggagacgucguguaugauggaucacugauugacuggcucccauacagcaggauaagugacuauguuggaacuugugaacgucuaauagaauuaguggacagaggucugguagagaaggugcuuccugggcacuucaauaccuuuggugcugaaaggcuuuuucgauuggcuucuaacuauauuucaaaagcugggauaugucacaaaguuucuacuuuugccaugcgaucucuugcaaguuuagcucuacguguaacaaauucuaggaccucgcccuaguaucuauacugauaauauauuuugauuaauuauauacauuaauucauucugugcuauuuaacugauuaauagugagcauuucaugaagugcuuuuauaccacuauuauauaucagagaaagauugagaaugaauaagccaaaaagaaaauuguuaguuuaaauuguuuucuuucuuccaagaaagaagccacuuaaauaagcuuauacuuugccaaagcugucaucuuguaauauaugcucuagaaaugacauaaagguuuauggggaagcaaagagagauuuuguggcaagagaacugcccuugccucuguuuuucuuguuuuauucccuugaugaccuagggaaaaaaaggcauguagaguauuauguuuauacuuuaaacuugauauuuuuaguguauuauuuaaagauaaagguucuuggguuuaaaauacauuagaacuuaaugcagacauauaaaguaacauugagaaugacaacuaaaacauuccauuguuaugguccugaauuuuuuaugcuucauuucauguauuuauucuuuguauaauuauagcauacauguuauguaauauaacuuaugaaaaguacagugaauuuugcuuuauugcaaagcuuuaaauauaaauuucagagugcuucaguaaaaagcuacuauauauuguuguuuguuauuguguagguaauauuuucaauuaugaaagugaaaugcaaaugucuguuaucuaacuacaaauugucagauuucuuaaaaggacacugucaggcaaauuugaaaauauacacauugagaauaauuuuuuauuauuauauccuauuuuaauauuaacagcuauuaugaacaaaauuuuuccuguuaaauagcgacuucaguauuguguuauguuuuacagcguuaaaacaacuaugaagaucugcagcuauucuuuuacuuaacaugcauauguacuacagagggauuuuuaaauuaauugcaaaaugugcauuagcuauugacuuagagugaauugccuuuuguauccugauucacaacaccuauuccuguucaguauucuuugucuugaauagagaagucuauguucguaaagucauauaaaagguuauaccacuauuuaguaaaaaguuuuaguuuggugcuguuaauaauaauuugcuaaaaggccuuuuagaauauuucauaaaggguuuuaaacaguuuuuucccacugccuuuuuauuauugacauaucuaaaaccaaacugaaaucgcuuuggaaaucagauuuuuuaauguuaggaagauccagcaauuuugguuucugaaaaauuacaaaacuuuucuacccuacagaugcccagguucuuuaguuuuuuauucauucaacucacacacacauaaacauauacauacacaaacacaaucccacaugcaaacacacacagccacauauauacauguguagcacagcgcuaaacacuguggaggcuaaaaaaagucaaagacaacauuauaacuaaaagucgaaagcacacaaaauauaaauaauaguguaugcaaguuaauguacauuauacaugcguguaagggacauaaauggaggggugugaacuuugguuaggcaaaguuuacuggaggagggguuuuugagucaaauuuggaaggaugaacuuguuagauagucagaguuggaaacaaaacaauccaagaauagggauauaagcauugcuagucuagaauagucuauuccuugugaaaauauaaauuuaauuuucaggaauccaguauauuccaaacaucacauauuuagcaugagaaaaauugauuugugauuguguauaugagucauuguuaaugggagacaagcugaacugccacaugccaccaaaugaaccuuuacuucaaucaaaaaggaggguaugauugguucaauuauauuaacagaauaucaugggcauuucucuaugauggucauucaagguaguaggucucuuucaacugagugcaacauugagaauaaugauuugguucagggcaacuacaaauaaucacuuacuaagccuuaaauaaagccauuauuuuuauaucaauagcacaaaggaaaaccaaaaguccuuaaccacugaccauuuuuaucauauuuuaggccuuuuuuuaaaaaaucaggguauaguaggcacuaaguuuuauuaggaaauauuuaaaccugcugaaggauuuauuuauaaaaagugcaauuuuucaaaacacauuauuauuuuuuaauuucccaauuuuuucaguuuuucaaauuguaccacaacauagaacugugauauuuugcuauuacuucaaugugaauaaauaagguaaaguauaucauuuauugagugcccaugcuguacauuuaaaauaugcauuauuuaauuuaaucuuacucccagcaccaaaagguaauugaccagccucaacacaauuuuggacaaagcuaguaacugaacacaggucugucugccccacacuucucuuucucuuguaacugcacaauagcagaaaauuggcaagauguauuuuuacuuuccaagaugccgugugugccaagaauaaaugaaaugauguuaaagcauaauaauaacauaucuuuaaaaagcuuuucaaaauauauuuucacccugacagugacccuuguaacuuaaaugauuuuuggaaauauuaguauguaaguauaauucaaaguugucaaaauguaagacauuuagaaguaauuuuuauuauuuauauuguuaauacuuaaucacuggaaauucauuuuccuuacucgauguuuucuuucaacugagaagccuaaaacaaacaaaaaccuuguguguuauccugauauaguugacuaaauguauuuguucuuauauggauaguaauaugaaugugacaugcaccaauuguccuauuauaauuuucagauaaguguaacuaagcacuuguguaauaaauauuagucauuuuauuucaa

SEQ ID NO: 192444 - RNA, 28756 nt, Homo sapiens
ucccagacagaaccuacuaugugcggcggcagcuggggcgggaaggcgggagcugggggcgcugggggcgcugcggccgcugcggccgcugcagccgcugcagcgccaggguccaccuggucggcugcaccuguggaggaggagguggauuucaggcuucccguagacuggaagaaucggcucaaaaccgcuugccucgcaggggcugagcuggaggcagcgaggccgcccgacgcaggcuuccggcgagacauggcagggcaaggauggcagcccggcggcagggccuggcgaggagcgcgagcccgcggccgcaguucccaggcgucugcgggcgcgagcacgccgcgacccugcgugcgccggggcgggggggcggggccucgccugcacaaauggggacgaggggggcggggcggccacaauuucgcgccaaacuugaccgcgcguucugcuguaacgagcgggcucggagguccucccgcugcugucaugguugguucgcuaaacugcaucgucgcugugucccagaacaugggcaucggcaagaacggggaccugcccuggccaccgcucagguaucugccgggccggggcgaugggacccaaacgggcgcaggcugcccacggucgggguggccgacucccggcgagaggauggggccagacuugcggucugcgcuggcaggaagggugggcccgacuggauuccccuuuucugcugcgcgggaggcccaguugcugauuucugcccggauucugcugcccggugaggucuuugcccugcggcgcccucgcccagggcaaagucccagcccuggagaaaacaccucaccccuacccacagcgcuccguuugucaggugccuuagagcucgagcccaagggauaauguuucgaguaacgcuguuucucuaacuuguaggaaugaauucagauauuuccagagaaugaccacaaccucuucaguagaagguaaugugggauuaaguagggucuugcuugaugaaguuuaccagugcaaauguuaguuaaauggaaaguuuuccguguuaaucugggaccuuuucucuuauuauggaucuguaugaucuguaugcaguucccaagguucauuuaccauuauuaaaaaauuuuugucuuagaaauuuuauguaugucaacgcacgagcaaauuaucaggcauggggcagaauuggcagcuggguggaggcuucgguggaggugagcacuccgaaaggaaaacagaguaggccuuuggaacagcugcuggaagagauaaggccugaacaagggcaguggagaagagaggguaaaaauuuuuuaagguuacaugacccuggauuuuggagaucucgaauuuaaaggugaugcaccagggaugaacgcucagauuuucaguuugaaagcuggcgugacauguaaaggaguggagaauaauguaccauuguaaugaugaggcgccucuaggacaucuaggauaauuucaggcguggggaucuaggugaauugaacuguuggagggaagggaauaaccaaggaaaagaauguggggguugagagaugccccguuuaaaaccuaagagaccuggauauuuaugguuguaagaggaggcauggcagaggaaauggaaacaguaagaaaggagcagaugcugcaucucuuuaaugggacagauacaaggcauuuggguuugacacuuaggucacugguagagaugaugacaagagcccguagcuaaagaauugauaaaagccagucucaaaaaucccaauauagucugguaauguuaauguuucuuugguucagauagcugacucucaaaguuauuuuccuaagaaacugaaccaaaaguggacgcuauauguaaaaaguuuuuauagaaguguuauaagaguaggauagagacauaauuaaacauguuuuaagguaauugaguggaacauuaagcaccuauuuuuaaaaguaugauuuaauaucaaucuacaaaguacacaaauauaauacaauuguaucagacaguugugacagcacugauuagaggcugaacauuauucuaagucuuuaauucccacaacaacccuagaagcaggaacuauuguuaucucuauuuuauagauaaaguaaaccacaagggguuaacacguuuugucuugugggugacaaaaugcauucaacuugagcacuuugacucagaaucuuuuuuuuuuuuuuuuuuaagagggagucuugcucugucgcccaggcuggagugcaguggcgcgaucuccgcucacugcaagcuccgccucccggguucacaccauucuucugccucagccuccugaguagcugggacuacagacgccugccaccacaccuggcuaauuuuuuguauuuuuaguagagacgggguuucaccguguuagccaggauggucucgaucuccugaccucgugaucugcccaucuuggccuccccagaaucuuuacuaugucauacacaauugcaaaugauuaaaacuaaauauuggauauaaauuggauaaugccaaagggaaaaauaguuagauuuagguaaugagugauaaguaugaauuuugguaagacuuuuaaguucaguuuuuuaaaggagaucucugccaaaccccaaaaacaaagagcccuaacaucagccuaaccagauuucaaauuucaucuuuuggcgguaugcauuuuuaacagucaccccucaacuaacacaucauccucccucaacucacauucuacuaaccccaucaaugcaacucccugcccaccuuacucaacauauacaccgcugcuagccccauaccccgaaccaaccaaaccccaaagacaccccauacgguuuauguagcuuacuuccucaaagcaauacacugaaaauguuucgacaggcucauaccaccccauaaacaaauagguuuggucguagccuauuagcucuuaguaagauuacacaugcaagcaucccugccccggugagucacccucuaaaucaccacgaucaaaaggaacaaguaucaagcacgcagcaacgcagcucaaaacgcuuagccuagccacacccccacgggagacagcagugauaaaccuuuagcaauaaacgaaaguuuaacuaagcuauacuaacccuaggguucgucaaguucgugccagccaccgcggucacacgauuaacccaagucaauagaaaccggcguaaagaguguuuuagaucaauuccccucaauaaagcuaaaauucaccugaguuguaaaaaacuccaguugauacaaaauaaacuacgaaaguggcuuuaacgcaucugaacacacaauagcuaagacccaaacugggauuagauaccccacuaugcuuagcccuaaacuucaacaguuaaauuaacaaaacugcucgccagaacacuacgagccacagcuuaaaacucaaaggaccuggcggugcuucauaucccucuagaggagccuguucuguaaucgauaaaccccgaucaaccucaccaccucuugcucagccuauauaccgccaucuucagcaaacccugacgaaggcugcaaaguaagcgcaaguacccacguaaagauguuaggucaagguguagcccaugagcuggcaagaaaugggcuacauuuucuacuucagaaaacuacgauaacccuuaugaaauuuaagggucgaagguggauuuagcaguaaacuaagaguagagugcguaguugaacagggcccugaagcgcguacacaccgcccgucacccuccucaaguauacuucaaaggacauuuaacuaaaaccccugcgcauuuauauagaggagauaagucguaacaugguaaguguacuggaaagugcacuuggacgaaccagaguguagcuuaacauaaagcacccaacuuacacuuaggagauuucaacucaacuugaccacucugagcuaaaccuagccccaaacccauuccaccuuacuaccaaacaaccuuaaccaaaccauuuacucaaauaaaguauaggcgauagaaauuguaaaccggcgcaauagauauaguaccgcaagggaaagaugaaaaauuauaaccaagcauaauauagcaaggacuaaccccuguaccuucugcauaaugaauuaacuagaaauaacuuugcaaagagaaccaaagcuaagacccccgaaaccagacgagcuaccuaagaacagcuaaaagagcauacccgucuauguagcaaaauagugggaagauucauagguagaggcgacaaaccuaccgagucuggugauagcugguuguccaagauagaaucuuaguucaacuuuaaauuuacccacagaacccuccaaaucccccuguaaauuuaacuguuaguccaaagaggaacagcucuuuggacacuaggaaaaaaccuuguaaagagaguaaaaaauuuaauacccauaguaggccuaaaagcagccaccaauuaagaaagcguucaagcucaacaccuaucauccgaaaaaucccaaacauaugacugaacuccuugcacccaauuggaccaaucuauuaccuuauagaagaacuaacguugguauaaguaacaugaaagcauucuccuccacauaagccuacaucagaccaaaauauuaaacugacaauuaacagccuaauaucuacaaccaaccaacaagccauuauuacccccacuguuaacccaacacaggcaugcccacaaggaaagguuaaaaaaaguaaaaggaacucggcaaaccuuaccccaccuguuuaccaaaaacaucaccucuagcauuaucaguauuagaggcaccccugcccggugacauauguuuaacggccgcgguacccuaaccgugcaaagguagcauaaucacuuguuccuuaaauagggacuuguaugaauggcuccacgaggguucagcugucucuuacuuucaaccagugaaauugaccugcccgugaagagacuuuuaaguucaguuuuuuaaaggagauccacuaaaugucaggauguccaucauaucuaugcacauagauaaguccucaaugucaucugugaguucuuggaaacugugacuuuaagugaaacaauguagagcaaaaccaauuuuaccauaggcuacuggauguacacaagaguuaaguuccuagggcauauugcuggucacaaaaacaucaccaaacuucuaaaugaaggccaaaaacacuucuaauagaaaacacugaaguaaauaugagcuauacauacauuuaagaagaauaaugugcaugucuuugggauguggaaggaaacuggaauaccuggagaaaccccaugcagacaugggaaaagcaugcagacuccacacagacgguggcccuggccaggaauugauuauuuuucucaucaacguuagaagaaaacgauguuauucaaggacauguuguauauaaauacaugaaaauauauguauauucccaaaauauacuuaggcuuucuuugugauuuuauagguaaacagaaucuggugauuauggguaagaagaccugguucuccauuccugagaagaaucgaccuuuaaaggguagaauuaauuuaguucucagcagagaacucaaguaaguaccuuaacauaaauucaccacaagaaaaucaugucucauaguggagaucaguauaugauaaaaugaaauuguauaaaaggagcuauugaugaagcugcuuaauaucacaaaggugauuauagaaaauuaauaagcaguuauuuauacuacaugacaauaacuuauucuacuaccugaguaauugauuucaucaccuugaaaaguuacauuaaacauuaaauagcucacugugguaucagauuugcaaguuaucuugaaccaucauucaguaggcccaaauauaaauuauacaguguaaucaauaaccuguaguuucacauaaagucaaaacaacuauuuuuugggacuugcuaaaauuaagugaugauccccuuucuggacccaacccuaaaugcaauaaaaugugaauuuuaggaugggcugaaaugggucauaaucuucuacucuguuauuccuaguuaaccacaauacccaauaauauuuuguacuuaacauucauuacccagugucugaagguaaaacauuucaaaguauugaaaugguucuagagauccuggagagaagcggguaucuccaguuagccucugcuaagaauuuuccuguccuccaacccaggguuggagucaguaguucaugaagccuggauaugcccuggugacuggagagugggagggguaaucauauuaagacugcccaggaagucaacuccaauggcuugggagguugagggguggccagaauuggaccuguguuaauccauucucauguucuuauaaagaacugcccaagacugggcaauuuguacaggaaagagguuuaauugacucacaguuccucauggcuggggaggccacaggaaauuuaaaaucaugguggaaggggaagcaaacgcauccuucuucacaugguggcaggaaggagaagugccgagcaaagggggaaaggccccuuauaaaaccaucagaucucaugagaacuuaacuaucacgagaacaucaugggggguaccaccccccauaauucauuuaucuccaccugguaucacccuugacauguggggauuauuacaauucaaggugagauuuuggcggagacacagccaaaccauaucaggaucuaaggggaaggucugggaucuggcauguuaaucauucuuagucuaauaauauaaucaccaaaaagaaugcaguauccuagggcacuacuuucuugggaacaguagucauaguauucuuuucccauguguauuggugaagauucaaccaaagaagcagaaccaguaguagauagauacagguauauuaaagaguuuuauugcgaggaauuggcuuacacaauuaugggggcuggguacgugaguccaaaaaucuguaaaacgggccaucagaaaggacaagcuggaauucuccagcaggggcugaagugguacaggugaaauuucuucaggaaagccucaacucuacucuuaaagccuuuaaacugauugauucagcccacucagauuaaagucugaccgggcacaguggcuaaccccugcaaucccagcacuuuggaaggccaaggcagguggaucacuugagcucaggaguuugagaccaaccgugcaacauaaugaaaccccgucucuacaaacaaauuagccaggcgugguggcauguaccuguaguuuccaggaggcagagguugcagugagccaagauaguaccacugcgcuccagccuaggcaacagagugagauccugucucaaaaaaauuuaaaaaaaaaacugaauuguaaucacaucuacaaaaugccuucaaagcaacaccuagauacaguaucugaauaaccaaggacuauauccuagucaaguuuaacacuaugggaaggaaagaacuacacagcuauauaggcuaaggggauucaggcuuacauagauuuucucccaaguucuuccuagaauggcauagguaaaaaccgagaagaaaguguauagaauauuugcauugauugccucugggcgacggggcagauuuguugaugugcaucuugcugccugcuuccaucuucaugcuguucuuucuucugguugcuaggaugcucugauuaucucuuuccuugguagauuucaaauucacagacuauaucgccauuccaagaaacucuuuaaugauauuuuugaauacuacucaaguuuguuuauggcuagcuuaagcucaaacagaaagaaaucucagugggggagauguucacuugagccagcauuucuccucgaauaugaugaguguaauuuuuuuuuacgaccuuccugugaugcauguaauuggguuugguugcuucuucuguauuuauauauaacauauguuggugucuugugcuuuuuuuuuuaaggcugagaaaauuuaaagucuuuguuaucaagcaugccagggaaauagugauaccaguuaguaaaaaauguuagagcucuuuuuuguuguuguucuuccuuccacuuccuuacuuguuggucagucccacacauauagugaacagcugcugagugccaggcacugcaggguccugaauaagagggcagagauuuauacauggaaaucacuugcuuaugccaacucuaaagauacuucauuuuucaccccucucccccaauguaagaagaaacugaauccucaaagugaucacaaaauuuucuaccaaacacuauaguaauuuaggguaaauauuucuuaaguaagguauugagggaaaaugcuuuuccaaaguugucuagacagucaaguuguggcuuuaaaagaacuugaggugagaagggugggaauggccacugaugaguacagaauguuuucuuuuuuggugugauggaacuguucuaaaaguagauaggagugaugcuugcucgacucugaaucuacuaaacgucacugaacuauacacuuuaaaaggguaaauguuauggugugugauuuauaucaauaaaguggcuuuuaaaagucuuuggaaccagccgggcacaguggcucacaucuguaaucccagcacuuugggaggccgaggugggcagaucacgaggucagguguucgagaccagccuggccaacauagcaaaaccccgucucuacugaaaauacaaaaauuagccaggcgugguggcaagcaccuguaaucccagcuacucgggaagcugaggcaggagaagcucuugaaccaggaggcagaaguugcagugagccaagacuauaccacugcacuccagccugggcaacagagcaagacuccgucucaaaaaaaaaaaaaaaaccucguuggaaccaaaaauuaaauaaacaaguuuuacuguaaugcuauaguagccuggacaccaucuuuagaaaauccaaaauugccuccauuauguaagauuuaaauagucucccauccacgaaaguuaacuuaauuucauguuauaauuuuuuacgaucucacuaucagaaucuccacagugauuaaaacuucuugaaggugcaguucucucucccccuaccacucacacacuuggaguagcaaacacugaccugguuucugaugucuacuauggcaccuaauaacuuugugacuuuaggcagguuacaaguaagccuuguugaaccucuuuccuuaccuauuaaaugagaugaauaaugacaacuuuuuugggugauuuugaagacucacugaaauuuuguauguaaaguuucuggcacacagaaggguauagauaucaguuccuacccccacccccauaaacuugcuacuuuauaucuuauagaacauacacauuaauauuaauauuaaugaaaucacagugaacagacucaugaucucauuuucaccuuaacauauuacuuuguucuuguuucccuccaucuugagacaaaaauccacugccaccuaaaucaacucucucaucuccccugacuugauucuggauuccuuuuuuucuaucuucaccuugcucugcugucccaaccuuuuaguauuaucaaaggcaaaauaaaaauuuugcgaugaauucucuaaauuuaacauuguguuugggaagaaaaaauugcaguuuagggcauacaugcagacaagugaccuuccauaugucugaagaacaaagggaagguuagagguuuuauuuaaaaggagaaauguuacugcucuuugagaaaguucauuggcacuacuaagguuugggggagcuagcaagcuccgacuggcgagcagugaguggugggcaaaaucaguucuagaguugcagcaaguuaucucagaagcuauagauaaaacugguuucagguuacaacaagcaguuccagcagucaggcuuacagagaauuacauucuuggagcaauguuuuauacccugagugcuuuuuuccccuggccccucaacucugauuuaguuggguaugacaagaaugacccacugucacccaggccagagggcaguggugugaucgcggcucacugcagccuccaccucccuggcucaagcaauucuccugccucagccucccaaguagcugggauaacaggcaugugccaccaugcccagcuaauuuuuguguuuuuuaguagaaaugggguuucuccauguuggccaggcuggucucaaacuccugaccucaggugaucugcccaccucagccucccaaagugcugggauuacaggcgugagccaccguguucggccuacccuguuuuaaaccucaccauaguuuacuuuucuucuacccucaacuuucucagagcuuucuuguauuaaauaacuuuaguaugauuaaaauaaaauucuauacuacacuuugguuguagucugucaugccugugccuuugcacauguuuuuaucuccuuugacacucaguuaaggagucaugcccugaggaguauucucccucaucaccccggcccugcguuccuguauagcguccucugcaugucuucguuguauguccuuucauacauuauagucacugcugagauauuucugacugcuaucacaaucucuuugaguucagggacugcauauuuuaucucuauccccagaaucuagcauaaccccuagcaaaguaggaauucaaaaaucacagaaugaauaguacauaggugauuuauaaaaauagaaccaucccacauaguaccacuuuguaacccaccucuuuuucccucaauauauuagaaaauaaaguccuguaaauauuuuuaguggcugcauaguauuccauuaugaggcuggaucauacccaauuuuuaauaugagcauaccucagagacacugcagguucaguuccagaccacugcaauaaauaaagcauaucacaauauagguagucacauaaauuuuuucucagugcauauaaaaguuauauuuacacuauacugauagucuaauagaugugcaauaguauaucuuuaaaaaauguauguaccuuaguuaaaauaugacuggaaaaugcuaacaaucauccgagccuucagugggucauaaucuucucacuauggagugucuugccuugauauugaugguugcugacugauaaaggugaugauugcugaaggcugggguggcuguggcaauuucuuaaaacaagaaugaaguuugccacauugauagacucuuccuuugaagaaagauuuuucuggagcaugugaugcuauuuuauaggauuuuacccacaacagaauuucuuucaaaaugggaaucaguccucucaaaccuugcuguugcuuuauuaacuuaguuugcauaguauucuaaaucuuucgugaucaacaauguucacagcaucuucacugggaguagauuucaucucaagaagccaguuucuuugcucauccauaagaaguaauuccuuauccauugacauuuuaucaugagauuccagcaauuccaucccaucuucaggccccacuuuuuuuuuuuuuuuuuuugagacggagucuugccuguggcccaggcuggagugcaguggcccgaucucagcucacugcaagcuccgccucccggguucacaccguucuccugccucagccucccuaguagcugggacuacaggugcccgccaccacgccugcuaguuuucuguauuuuuuaguagagacagggucucacuguguuagccaggauggucuccaucuccugaccucgugauccguccaccuuggccucccaaagugcugggauuacaggcauuagccaccacacccagcccagguuccacuucuaauucuaguucucuugccauuuccaccacaucugcaguuauuuccacccccaaagucuuaaaccccucaaagccaucaugaggguuggaaucaacuaacuccaaacuccuguuaauguugauauuuugaucuccuaugaaucaugaauguuguuaaugccaucuagaauagugaauccuuuuuagaagguuuuccauugacuuugcccagauccaucagaggcuauugcagcuacggccuuacaaaauguauuucuuaaauaguaagacuugaaagucaaaauuacuccuugauccaugggcugcagaaugagcaggaauauuuugaaaggaaucuuccuuccugagaaguaggucucaacaggaggcuuuaaauauuuagugaaccaugcuauaaacagacgugcugucauccaaacuucguuguuccauuucuaauacacaggcagaguauauuuagcguaauucuuaaaggcccugggauuuucagaaugguaaaugagcauuggcuuccacugaaagucaucagcuugcauuagcuccuaacaagagaaucagccuguucuuugaaacuuugaaacuaggcauugacuucuccuuuauagcuaugaaguccuagauggcaucuuccuugaauagcaggcuauuuugucuccacugaaaaucuguucuuaguguagccaccuucaucaaugaucuuagccagaucuucuggauaaacuugcugcagcuucuacauuagcacuugcugcuucaccuugcacuuuuuucuuauggagacagcuuuuuccuuaaacgucaugaaccaaacccuugcuaguuucaaacuuuucuucuauagcuuucucaccucucucagccuuuacagaauuaaagaggguuaaagccuuguucuagauugggcuuuggcauaagguacuguggcugguuugaucuauccagaccacucagcuuccucuacaucagcaauaaggcuguuugcuuuuuuguuuuuguuuuuguuugagacggagucucgcucuuucgcccaggcuggagagugcaguggcgugaucucagcucacugcaagcuccaccuccuggguucacgccauuuuccugccucagccccccaaguagcugggacuacaggcaccugccaccaugccuagccaggcauacacuuuuuuguauuuuuaguagagacaggguuucacuguguuagccaggauggucucgaucuccugaccucgugauccgcccaccucggccucccaaagugcugggauuacaggcgugacccaccgcgccuggccaagcuguuugcuuucuuaccauucacauuuucacuggaauagcacuuccaauuuccuucaagagcuuuucuuuuguauuuacaacuuggcuguuagaugcaagaggcauggcuuuuggccugucuuggcuuugaugugccuccuucacuaagcauaaucauuucuagcuuuugauuuuacaugagaaauaugcgacucuuccuuucacuuguacgcuuagaggccauuguaggguuauuaauuggccucauuucaauauuguugugucucagggaauugggaggccagaagagggggagagaaacaggaauagccaguuaguggagcugucagaacacauaacauguaucgauucaccaucuuaaaagggcaugauuuauggcaccccauaacaguuacuugcaacaguaacagcaagauccccaaaacguauuuuaauaaugaaaaagccugaaauauuguggaaauuaccaaaagguaacagagauagaaagugaacacaugcuguuggaaaaacuucaccaguagaccugcucagugcaggguuggcacaaaccuucaauuuguaaaaaagaaaaacaccuuuauaucugugaagcacaguaaaaugagguauggcuuaguagggaaccccauuuuuaaaggcucaguaugaagggucuuaaauugaagauguauuuuugcguucugguuaagacacuauuccauuucaggguuuuuuguuuuuaagugguuucccaacacuccucagggaaauugagcaagaauuccaucggcaguccucacaucaggaacagugaaaaaggauaauguuuauauggcacccgagauaaucagauaaggccagaagacaagagucagaggguucugccuaaucuaagccccaccauccugauguuuaagggccccugaaucggaggacccugccacaggcaccaacugaagucuuuuguccauguaacaaauugcagcucaaguuucaaagucaaaucuguuggaguucaacucggagguccaucauuucccggcugugugaccaguaguuucuuaaccauucagccucaguuuccucaucuauaaaaaggaaugauaguaccacguacaauugccaguuaaaugcaguguguacauuaucucauuuagucuucaugcaaaccuucaagacucaaucacaaagaaauguccacacauuucuuaacaaagaauacauaugcuacuacauaccaacucuccuuugucagggaauccaaucuagauugguuuaaaauaauuauaggaaagaaauucagcagugaaauaugugacuauauuggaugcuugcuauuugucauuuacuguauuucuagcgcuugugccauguaagggcugaugaacucaaaccguagcucagcuuuuugcaugcucuuuuuuacccaccuagagguccaguguuuccugugauacuuaccucuaaacugcuaaauagccacauuuuacggaagcauauucuucauaccuuugcucuaacuuaaaucucuaacuuugcacuauauuuaauauggguuuuuuggggggaaggggggaguggaguugguuuuuuuugagacagagucucgcugucucgcccaggcuggagugcaguggcacaaucucagcucacugcaaacucugucuccuggauucaagcgauucuccugucugagccucccaaguaccugagauuacaggcacgugccaccacacccagcuaauuuuucuauuuuuaauagagacgggguuucacuuuguuggccaggcuggucuggaacuccugaccucccgugauccgcccaucucagccucccaaagugcugggauuacaggcgugagccaccacaccuggcuaaucuguucuucacuuucuuuucuauacucacuacaaaaaagggcaaggaagucuucacagcugcacuuacuaacaccgucacggcucuguuuuggccaucaucuguuuauuaacuaaacucucuucucucccaacuccaaaucuuuguuucuucuagauugaguucucucccugaagagccuaauccaaccuggucccuguaacugcccugauaccuuaggagauaccugggcuuauuuaacuucucucuggccaccaugucuuuuuccagccugagucaaaguauauucuuugcucuaaccuaauucuuuuaagaaugacagaguaaaauaaguaaaauuuauaugaggagggagagggaggaggcaaucaagagaaugaauagucccuauucuugauuaauccuuauuauaacuaugaguucaagggcaauuauauaaucuuguuaaagcaccaggcuaaaaacuugacauggaauuguaauuucuguuguguaucuaauuacuaugaaagccuaguucuaccuguuucaucauuuauaaagggaauugcaacccccaccacgaccaacaaaguaguuucagagauugggagggacuaagcuagucaauguaaaccaagcuuguccagcccauggcccgcaggccucaguguggcccaggauggcuuugaaugcugcccaacacaaauuaguaaauuuccuuaaaacaugcacagaucuuuuuuuuuuuaaagcucaucagcuauuguuaauguuuguguauuguauguguggcccaagacaauucuucuuccaauguggccaagagaagccaaaauauuggaccaccccugaguaaacacugaaauuaauuaacuucuucccuuuuggauuuuaauuacauaaguaauaauaagcucauuuuuuaauacuucacccauuccuguauuguuugaaacauaaauccuuuccccauucccaaagguaacaacauauuaacagucugaaugucauuccaagcuuuucugcagucauucaaacauaucacucuuuuucuaauauuaggaaaaucuucacacauacagaaagaacuuuacaguaaacucaccaccuagaucuaccauuaacauuuuacucuacuaguuucaucacauuucauccaucaauuggucuuguucauuuuugcauuucauaauaaacugcagacauuaguauauuuccaccuaaauacuucaucauucauaccauuaaugauucagucuuggccgggugcgguggcucacgccuguaaucccagaacucugggaggccaaggcgggcagaucagcagguuaggagauugagaccaucauggcuaacacggugaaaccacgucucuucuaaaaauacaaaaaauuagccgggcgugguggcaggcaccuguagucccagcuacucaggaagcuaaggcaggagaauggcaugaaccugggaggcggagcuugcagugagcugagaucgcgccacuguacuccagccugggcuacagagcaagacuccgucucauucauaaauaaauaaauaaauaaaaugauucagucuuucuuuacaguuuuuuucugaaguaaauauuacaugagacacacgucuuaaauguacauuugcuaaguuuugauaaauguauacaccuguguaaccccagcccuaucaaagauacagaauauuaccuaucacccccagaaaguucucuccugcccuguccaaguuaaucuuuaucccaccccuccagaaauaacuacuauucugauguuuuuccaccagagauaucacaagauaucacaugguuuuaugauucauugugaaccacagauguacaaauauagguuaaauuauuggucagaggccauacugauguuaagugcuuuuuguugaaaggauucauauuuaugaugauuuuaguucuauagucacugcaucuuagucagauuauuugacuaguauggauggauuuuacaaacauuuuguggaauucuuuuuuuaaccuuagggaaccuccacaaggagcucauuuucuuuccagaagucuagaugaugccuuaaaacuuacugaacaaccagaauuagcaaauaaaguagacauggucuggauaguugguggcaguucuguuuauaagguaaguguaguuguugguaaauaaaaacaaauguucuguucuacuuucagcuuccuugccauuuaaaggaaguggaagaaacagguauaacucauugucugaaccuuuaaaaaauuaagccaugcguauaggaagcagcacauuaucuguacuguaaauuauuuguuguuaguugaaauuauuuguuguuugauacuauacaaacuaaauagaaaugcaaaaauaaauauuuuagucuguaucagccuuuuuuauuuauucauuuauuuuugagacagggucuugcuuugucacccaggcuagugugcaguggcacugucucacuguagccucgagcuccaaggcccaagcaauccucccaccuuuccucccaaguagcugggauuauaggcacacaccaucgugcccggcuaauuuuuguauauuuuguagagucaggauuuugccauguugcccaggccggucuugaacuccuggguucaggcaauucaccucccaaugugcugggauuacaggugugaaccaccacacccagccuauuuaucuuuuuaauuggcaaauaauugcauauauauauauauauauauauauauauauuauguacaacauguuguuuugaaauguguauacauuguagaauggcuaaauggagcuaauuaacauguauuacccacuuauuuugugugguaagaacacuuaaagucuacucucuuagcaauuuucaagaauacauuuguuauuaacuaaaauaauagauguuguacaauagaucucuugaacuuacuccuccuauguaacugaaauuuuguauccugugaccaacaucuccccaauaccaaucuacuuucaaaucaaagaauaauugauguuuccaauuuaaaauccauucuaaaucuuuuccugagaauuguacuugcauugcacugguuucuacucccugaauguacccuagauacacugaguuaugccuuugucuuucaggaugaauauaucucuuacugagaaaggguuggggcucucaguugauauacacuaacuagauguauaugaauuuauuacaaguagaaaacuucuucaaccaauuuuuuuuuguuuuguuuuuguuuuuuugagauggagucucacucugucaagacucagucgcccaggcuggagugcagugacacgaucuucggcucacugcaagcuccaccugccagauugacgccauucuccugccucagccuccugaguagcugggacuacaggcgcaugccaccacaccuggcuaauuuuuuuguauuuuuaguagagacgggguuucacuguguuagccaggauggucucaaucuccugaccugcugauccacgcaccucggccucccaaaguguugggauuacaggcgugacccacugcgcccggccaauauaccucuuuuuuaauaccaaaugacuuccagcuuuaaaauuuuugaggauaacaaauagaauucuuugccuuuuaaaacaccaaugaaaaauuaacauuuaugaggaggaagaaaaaucuaguuucugccauguggguggucuugugguaagauauauacagugaaauuauuuuagaaagaagagguaggccgacgccuguaaucccagcacuuugggaggccaaggcggguggauugcuugaggucaggaucuaaaaaccagcugggccaagauggugaaacuccaucucuccuaaaaauacaaaaauuaguugugugugggcgcgggccccuguagucccagcuacuugggaggcugaggugggaaaaucacuugaacauggggggcagagguugcaguaagcugagaucgugccacugcacuccagccuggguaacagagugagacucugucucaaaaaaaaaaaaaaaaaaaaaaaaaacucucaguuucuugggcuccuguuucuagaaccucuuauguuccccauuuguaauagaagaaaagggacauuuuuucuugauauuuuuauccaaguaugaauuucuucuaagaaaacaaguuauuuauuuuguucagugccuaccacacuuugaaugauucauuaccauagucacuugaaaauguauucuuuaagcaauauaaguacguaaaugccuuuauauaauaugauaaaucuacauauagauaaauaggaaguagaaccuucgaaugguauuuuuacaccugccucacaucacaacagcuuguagauaucauucaggcuuaucuuccuaugggccaaaucggaccucccagccuguuuuuguaaagaaaguuucaguggaacacagacccacccauucauucaguucugucuguggccugcaaagguaggaaacccuauggcccucagagccuaaaauauuuaccaucacuccuuuuacagaagguuugccuuguauaaucaacuuuuuuuuucuuuuuuuuugagacggaguuucgcucuuuuugcccaggcuggagcgcaauggugcagucuuggcucaccgcaaccuccgccucccggguucaagugauucuccugccucagccucccaaguagcugggauuacaggcaugcgccaccacgcccagcuaauuuuguauuuuaaguagagauggaguuucuccauguuggucgggcuggucucaaacuccugacuucaggugauccaccugccucggccucccaaagugcugggauuacagacguaagccacugcagccgacuuauaaucaacuuuaaugcagaacuucaccaccacagucaaucuaauaauccagacagcuccuaagugacuaaggggcagguaacauagacagcaugugcaggacaaagggauaauucacgcccuaggcaggacagagcagaauggcucaagauuucuucacacuacuuagaacagcaugucauuuaaaucuuaugaauuauuucuggaauuuuccaguuaauauuuucagaccacaguugaccauagauaacaaacuggaaagugaaacugcagauaaggggggagucugcauuccacuuuuuaaauuuuugguacaguaagaauuaguagagcaucuauuugguuguagcaaagauaauaaaugauuuaauauaaaaugauauauugaaaauaaaaagugaaauuuguucuguacccuuauuuggaauuuuaaaaauaaacacuuggauuuguuguguguguguguguguguguguauuuuucuuuucuauaaacuauuugagaucaagaauuacugcuuuguuagaauugcaauuaagacauacuuuuuaugaaugagaauuuuaauacacucauucuagggcaacuuuuucuguagaaauuaucaaccauauuuuaggcaguaguuagaaaagucauguacaauauaaagccaaauguuaauacaauuguuagcaccaagaagcagaaaaauuaccuaucuacuagcauuguaauuaucuucugagaauuggaagcauuacaaaauuuuauguauauguauuaaguaugcucuugggguuuuccauagucaaggucucauuaaauuguacuaucuuauucauacaaguuuauguaaauuuuucuauggagagcaacuagauaauuuggggcucuuaacucuaaacagccaaagggaaaacaauaaaagagaaugcuuaaauuaaaaaguucuuguaagcaaacuggaggccagacuauauuuaaacucagucucucauaauuauugauaaugguuagugucauucucaauauaacuaaggcauacuuugcagcaccccagaugaaagaauaguauauuuuaauaauaugcuuuggcagcaccaagcauauuuuuaauaccuaguauaaacuuaacuaaacauaaaucuuagaguuucuuugucuuuugacacacauuaagaaaacugauguuguuuuauuucaaaggaagccaugaaucacccaggccaucuuaaacuauuugugacaaggaucaugcaagacuuugaaagugacacguuuuuuccagaaauugauuuggagaaauauaaacuucugccagaguaaguauaagguuauuaauuagucugaagcacuuuggauuuccugcuuaagacuauagaaaauaacaugucuuuucagacuacaaauuggguucacuguguacugcuaggaugaugggugcaccaaaaucucacagaucacuacuaaagaacuuacucauguaaccaaauacaaccuguuccccaaaaaccuauggaaauaauaaauuaaaaaaaaaaaaaaaaagcuuggcacagugacucaugccuguaaucccagcacuuugggaggucgaggcaggggcagaucaccugaggucaggaguucaagaccagccuggccaacauggugaaaccccgucucuacuaaaaauacaacaaauuagcugggcaugguggugcaugccuguaaucccagcuacuugggaggcucaggcaggagaacugcuuguuccugggaggcagaggucguaguaagccaagaucacgccauugcacuccagccugggcgacagagcaagaccgucucaaaaacaaacaaaaaaaaauauuaaguauuuuaacaccugagcaugugaugucuuuccccuuguuuagguccuauuucguucagcgauguuuuauaccuuucaguguuaauuucauacuuauguauucuauuccuuuugaugcuauuguaaaugguauuuucuuuaguuucagacuguuuauugcuaguuacagaaaugcaaaugauuuuuguuuauugaucuuguaucuugcaaccuugcugaacucauuuguaauucugucaauagauuccuuaggauuuucucuauacaguauaaugucaucugcaaauauagguuuacuucuuccuuuuuaaucuggauuuuuucuuugccuaauugccguggcuagaccugccaguacaguguugacuaaaagauagcaagagcagacuuacuuaucuugcuccuaaucuuagaggggaagcuuuucucucucaucaagugcgauuuaagcugugagugccuuuaucacauugaggaagaucccuucuguuuccaguuuauuuaguauuuuuuaucaugagaguauuauacauuuugugacaugcuuuuucugagucuauugagaugaucaugugguuuuugucuuuuauacuaauauuuuaauguacuauuaauaugguauaucacauugauuuucauguuaaacuaauguuucugggauaaauucuacuugguaaugguauauaauccuuuuuauauguuacugggcuuagguugcuaguauuuuguugaagauuuuugcauuuauauucagaagggaugauuuauaguuuuuuuuguuuuaaugccuuccccugguuuuguuaucaggauaaaagugaccucauagagugaguuaggagauguucucuucccuucuguuuuuuugaaagaguuugugacagauuguuaguacuucuuaaaugucuuagaaaauuuuaauagugaaucgauugagagaggaauacggaaauugcuccaaaguggagauucuaaacaaggcuaugggagaaagcaaaaaacucuuccauugcaacauuugauggucauuuguacuuucaggcauguacuaacauaacaucauaacagccucuuuaauggaauggagggaauucucuaacgggagaccuagaguaagucaguccuucauucuauggagaaaaaggaaaccugugaagauaaagugaauauacuuugucccuggaaaacacauugcucaguucuggagcggcuuucucuccagaucucugugcgcuggggaacuuagauuugcuuucuacuguccaaauauaaacuuuggucauucuccaccuccccuaucccuuuccccacagcuacucacuuaguuuaagucccguugucucuaucaguuaaccucuugugguuauauagguuucuguucaaacauaaagucuuuuauuaacaccauucuucccgauuuaaaaaauaaacagacuaauauagugaaauacagaugaaagagagaacuugugagacaagaagagaauaaaauuagaauguggaaggagccacaagugaugggagccagagcagacggucauauuaauaaaguaaggugguuuuacuuugugucugccgucagcucuguacgucauugugcagucgauuuuucaacagcacugugccagccuauccucuagggcucugcucucauucaucuugccuggaagaaaucuuucucagacuauuucacacuagaccccaaccaaaccagcaggcccagauauuuuauauuggcaguuuucuacuuaaugagccccaaacaggcuuuuacuucuaguuaacaaucuucugugugaccacauagucaaagagaagacagauuaaaagaggccuguggaggcaguaguuggcuccagagcugggacagaugccccuuaucaguggacaccuugaaguagguuuuggaugggcugauguuucuucuucugacccuaaaacuuccugucaggaugcuggcauacucguccacaugacucggauaucccuuugcuccugagccugugcuuccuguagagucuugauuuuaauuguauuuugguuuuuugguuuauuuuuuguuuuugagauggagucuugcuccguugcccaggcuggagugcaguggcacgaucuuggcucauugcaaccuccaccucccagguucagcgauucuccugccucagccucccaaguagcugggauuacaggcacgugccgccaugcccagcuaauuuuuguauuuuuaguagagacaggguuucaucauguuggccaggcuugucucgaacuccugaccucagaugauccgcccgccucggccucagccucccagagugcugggauuggaggcaugagccaccgcacauggcccaaaaacuucuugauauguugcuuuugucuuaugaacugacaaucuugacacuugagaauuuugcacaaaaaauguauguagauguuacuuuucaugacucauuccagagagacuaaaauuauaauagaaaaugguuaauagaaacauugcuucuuccccugaaauauaaauuauuccagaaaguaucuuuuucuuuucccuauaauuuuguuacauuguaucucuguuuuuguuuuuuuuuuuaccaaaaaugcauaaucucuaauuagucagcaaagguuaaugucuauuauuacucagcaauguauugaauaucaugagacuuaaaaguuuacuguguugucccugccuacaaugaguuuaaaaaauagagaaacgaggcgggcggaucacgaggucaggagaucgagaacauccuggcuaacacagugaaaccccgucucuacuaaaaauacaaaaaauuagcuggaugugguggcggguaccuguagucccagcuacucgggaggcugaggcaggagaauggcaugaacccaggaggcggagcuugcagugagccaagauugcaccacugaacucuagccugggcuacagagcgagacuccgucucaaaaaaaaaaaaaaaaaaagagaaaugaaacaaaccaauaauacuaguaggcaccauuuauagaacacuugauguguuaggcacaaugcuacauucuuuuuugguuuugggggaugggggcggaguccugcucugucacugaagcuggagugcaguggcgccaucuuggcucacugcaaccucugccucccagguucaagcaauuauccugccucagccuccugaguagcugggauuacaggcacccgccaccaugcccggguaauuuuuguauuuuuauuagagacaagguuuccccauguuggccaggcugguuucgaacuccugaccucaagugauccacucaccuuggccuuccaaagugcugggauuacaggcgugagccacugcaccuggccaacaaugcuacauuuuuuacaaggaugaagacuuuauugacagccaggcucggaggcaugucacacagcagaaccagagugaagcacagucugauucaagcaggcguuccugaccaccuggagcauacuggggugcagccugcauaguacugaagaaguaaccaaagauugggguucauuggaggcuggaagggucagaagauuccucaguggagaagcuggguuuggaaggggagcuggagagaacacaggcuuaagugagaguuagggaacaggaauagcagauccuaauaaaggaauuacaaucugccacacauuguggaauuagggcaguauagucuccaucaaucaaacagaagcagagaaccugucacuguccagggcacauaauuucaguuauguucuaaacagcuucagauuguauuuuugucuuuugcuuacacaagaaaugugauaccaaauguaagucuugcaaaaaauucuuaagaaauuuccuguuagcugggugauagaguggaaagauacaagggaaacugcugacugguuuuugagagaaugaggaauccaaaggaaacaaaaaaggagaaauuacacuuuuuguuuucuaacuuucuauauaguuuacaguuuuuuucuuaccauuugcauauguaguauacuagcaugauauuuauccaacuugacaguggcuuaccauugugaagaaaaaagggaaaccuuuuauuugcuuuaugcacuauugaugcauuuaaacugagaaucagggaagcuguguuuuuaauggacacauaauuuaauuauauauuuuuucuuacagauacccagguguucucucugauguccaggaggagaaaggcauuaaguacaaauuugaaguauaugagaagaaugauuaauaugaagguguuuucuaguuuaaguuguucccccucccucugaaaaaaguauguauuuuuacauuagaaaagguuuuuuguugacuuuagaucuauaauuauuucuaagcaacuaguuuuuauuccccacuacucuugucucuaucagauaccauuuaugagacauucuugcuauaacuaagugcuucuccaagaccccaacugaguccccagcaccugcuacagugagcugccauuccacacccaucacauguggcacucuugccaguccuugacauugucgggcuuuucacauguugguaauauuuauuaaagaugaagauccacauacccuucaacugagcaguuucacuaguggaaauaccaaaagcuuccuacguguauauccagagguuuguagauaaauguugccaccuuguuuguaacagugaaaaauugaaaacaaccuggaaguccagugaugggaaaaugaguauguuucugucuuagauuggggaacccaaagcagauugcaagacugaaauuucagugaaagcaguguauuugcuaggucauaccagaaaucaucaauugagguacggagaaacugaacugagaagguaagaaaagcaauuuaaagucagcgagcagguucucauugauaacaagcuccauacugcugagauacagggaaauggaggggggaaagcuggaguauugaucccgccccccuccuugguugucagcucccuguccugugugugggcggaacauaguccagcugcucuauagcaagucucagguguuugcaguaagaagcugcuggcaugcacgggaacagugaaugccaaacacuuaaagcaauucgauguuuaaguauguaaguucuuuuuuuuuuagacagcguuucgcucuuguugcccaggcuagcaugcaauggugugaccucggcuuacugcaaccuccgccuucccagauucaagcgauucuccugccucaggcucccaaguagcuaggaccaggugcgcgccaccacgcccggcuaauuuuuguauuuuguauuuuuaguagagaugggguuucaccauguuggucaggcuagucucgaacucgugaccgcaagcgauucacccaccucagccucccaaagugcugggauuaccggcuugagccaccacacccggcacaucuucauucuuuuuauguaguaaaaaguauaaggccacacaugguuuauuugaaguauuuuauaauuuaaaaaaauacagaagcaggaaaaccaauuauaaguucaagugagggaugaugguugcuugaaccaaaggguugcauguaguaagaaauugugauuuaagauauauuuuaaaguuauaaguagcaggauauucugauggaguuugacuuugguuuugggcccagggaguuucagaugccuuugagaaaugaaugaaguagagagaaaauaaaagaaaaaccagccaggcacaguggcucacaccuguaaucccagcgcuuugggaggcuaaggcaggcagaucacuugagaccagcuugggcaacauggcaaagccccaucucuacaaaaaacacaaaaauuagcugggcauuguggcgcacaccuguauucccaucuagucaggaagcugagauggaagaauuaauugagcccacgaguucaaggcugcagugagucgugauugugccacugcacuccagccggggugacagaagagaccuugucucgaaaaggaaucugaaaacaauggaaccaugccuucauaauucuagaaaguuauuuucaacugauaaaucuauauucacccaaauaaucaagggugaagguaaaauaauacauuuuuagacaagcaaagacucagggguuaccuccaugugcccuuuuuagggaagcuguuggagaaaauacuccagcaaaaugaaggaguacacaaaccagagaaugacaugaauccagcaaauaggauccaacacaggcaauauuccagcuauggagcuagcuuuaaaaaggaacaguaaaaauauuaaucgguuagcuggguggaauggcccaugccuguagucccagcuacucaggaggcucagcagcaggacgacuugagcccaagaguuccagaccagccuggccaccuuagugagaucccuucucuuaaaaauaauaacuuauugccagauuuggggcauuuggaaagaaguucauugaagauaaagcaaaaguaaaaaaaaaaaaaaaaaaaacaaggggaaaggguugguuaggcaaucauucuagggcagaaagaaguacaggauaggaagagcauaauacacuguuuuucucaacaaggagcaguauguacacagucauaaugaugugacugcuuagccccuaaauaugguaacuacucugggacaauaugggaggaaaagugaagauugugaugguguaagagcuaaauccucaucugucauauccagaaaucacuauauaauauauaauaaugaaaugacuaaguuaugugaggaaaaaaacagaagacauugcuaaaagaguuaaaagucauugcucuggagaauuaggagggauggggcaggggacuguuaggaugcauuauaaacugaaaagccuuuuuaaaauuuuauguauuaauauaugcauucacuugaaaaacuaaaaaaaaacaauaauuuggaaaaacccaugaagguaacuaacggaaggaaaaacuaagagaaugaaaaguauuugccucuggaaagaacaacuggcaggacuguuguuuucauuguaagacuuuuggagccauuuaauuguacuuaaccauuuucaucuauuucuuuaauaagaacaauuccaucuuaauaaagaguuacacuuguuaauaagu

SEQ ID NO: 192445 - RNA, 144849 nt, Homo sapiens
cgaauugaggaguccuuuauuagccagcgaccgagagacggcuagugcucaaaauucucucggcccugaagaaggggcuagauuuuguuuuauacuuugguuuagagaggggagggggagccuagcuguagcagucuuacagaaguaaaacaggcaaaagaaguuaaaaagacaaaugguuacaggaaagcaaacaguuccaggugcaggggcuuuaaauccaucacaaggugauagacgcugggcuuugggugcuaucaaccagacaaaaacacaggggcuuaggguaauaucaacuggacaaauuccugggaacugcggacauagcuugccacagcauguuaucaguuaauugcauucuuugaugugcugggagucagcuugcacaaguuaauuccuugaggaaggggguggguaaggagcccuugaugucuugcaaaugaaggagccaaauggaguccguucagguuucucagcuaagagagagucaaucagguuaauacaaguuaggguaucacaagugugucuauuuagaaaaggaagacuuaagaaacuccauuuugaucuguacccugaacaaugguuuugccuugagaugcuguuaaucuguaacuuuucuccagccuugugcucacagaaacauguguuguauggaauuaagguuuaagggaucuagggcugugcaggaugugccuuguuaacaauauguuuacaggcaguaugcuugguaaaagucaucgccauucuccauucucgauuaaccaggggcacgaugcacugcggaaagccgcagggaccucugcccaggaaaaccggguauuguccaaaguuccuccccacugagacagccugagauauguccucaugggaugggaaagaccugaccgucccccagcccgacacccgugaagggucugugcugaggagaauuaguaaaagaggaaggccucugucucauaccgaacggaaugucucgguauaaaacccgauuguagaaaaccacacuggcaggaggcgagauaugcuggcggcaauuauucuuuauucuguuauucuuuacuacacugagauguuuggguggagagaagcauaaaucuggccuacgugcacauccaggcauaguaccuucccuugaacuuauuugugacacacauuccuuugcucacguuuucuugcugaccuucuccccacuaucacccuguucuccugccgcuuccucuugcugagauagugaaaauaguaaucaauaaauacugagggaacucagagaccggugcuggugcagguccuccguaugcugagcgccagucugcugggcccacuguucuuucucuauacuuugucucugugucuuacuucuuuucucagucucucgucccaccugacgagaaauacccacagguguggaggggcaaaccaccccuucaugugauguuuaggccgggugcaauagcccgcgccuguaaucccagcacuuugggaggccgagguaggagguucacuugaacccaggaguucaagaccagccugggcaacauaaugagaccucauuucuaaaaaauaaauaaauaaauaaaaauuguuuuaauuagcugggcaugguggugcacaccuguagucacaggugcucgagaggcugaggugggagaaucaguucagcccaggaguucaaggcugcagugagcugugaucgcaccacugcacuccagccuggacaauaaagugagaccgugucucaaaaauaguaugauuuuuuuaauagcugcauaauagucuccccuauggauauuuuuauuguuuacuuaaugcuugcccuauuuggggccauugaaguuguuuaauucuuuuuccaauauaaauaauuuuauucuggccauguuuuuauugaaaucucuaacccuauaaucucuuuuuuuccuuagaauagguuuccaggauugggauauuggaacaaaagguuaaauauucuuaaaguuccugauagauguuguugaauuguuuccagaaagcuucaacaaauucauccccucuagccauagugccuguuucaagaaaugaucagcauuguccauuaucuucuuuuauuuuuucccaauuugguagguaaaacuaguaucauuucuagucugcauucugcuugacucucguguggcugaacauuuuuuucugaguggcauagccauucauguuucuucugugacgggucuggacacauccucagugcucucauuuucaggagagcaaggauggggaacgaggggauaugcauuguauuaguuuguuuucaugcugcugauaaagacauaccagagacugggaagaaaaagagguuuaauuggacuuacaguuccacauggcuggggaggccucagaaucauggcaggaggugaaaggcacuucuuacauggcagcagcaagagaaaaagagggagaagcaaaagcagaaaacccugauaaacccaucagcucucaugagacuuauucacuaucacaagaauagcacgagaaagaccggcccccaugauucaauuaccucacccuggcccccucccacaacaugugggaauucugggagauacaauucaaguugagauuuggguggggacacagccaaacuauaucaugcaucaccaccugauggcacccacccauaaccucugccaugcugugugcccccccacccaugccugugggcgaggcuccccaggccuggugccuuugcugccagacucuggguacuuccauucacacucccaucucuggguguccucaagauaacccgauguucccaggauccuucccucaauuaacaaugaccugcccuagccccauuucuucagcaccgucuccaugcuaaguuacaaggagugggcccaaacaaacaacugaaagcuaaacgucuucaccuaaccaaaauguuggccgucuguauuagucuguuuucauacugcuauaaagacuaccugagacuggguaauuuauaaagaaaggagguuuaauugacucacaguucugcauggcuggggaggccucaggaaacuuacaaucauggcagaaggugaaggggaagcaaggcacaucuuacaaggcagcagaagagaaagagcauguagaagaaacugccacucuuaaaucaucagaucacggcugggugcaguggcucacaccuauaaucccagcacuuugggagguugaggcaggcagaucacuugaggucaggaguucgagaccagccuggccaacaugguaaaaccccaucaccacuaaaaauacaaaaauuagcucaccaugguggcacaugccuguaaccccagcuacuugggaggcugaggcaagagaaucgcuugacaucugggagguggagguugcagugagccaagaucaugccacuguacuccagccugggcaacagagugggacuccaucucaaaaaaaaaaaaaaaaaaggucagaucuugugagaacucccucaccaucacaagaacagcauuggggaaaccgccuucaugauccaaucacucccaccaggucccucccacaacauggggggauuacaauuugagaugagauuuggguggggacacagggccaaaccauaucaccacccacaaaagcuuuuugacaaauaacucugacuaggaauuguaagaaauguuuuuaaaugaguaagguggaagcaaacauuauucccauuuuauagacaagaaaugugugucucuggaucugugacacuccauaaaccagggaaaaggcagagacaaugacugauuuucugccgcccaauccaguugcccaacccuccuggcucaaugccaggacuucccugucuuugauuagggaaaguggagccacccacucccuacaugcaacuguuacacacccagugucccagaaaugacauucaacuucacuauagcgacugcuuuuacugacaucauuuuuagcagacguuuuacuauaaaaauggguggggagaaauaaagcagauaaacugcugccaaggaccaucacugcuagggugaaacugggggcacacgguauagcucaaaugcaccccagguccagcccaagccuugcucaaaacccacccaggaaccagaccuaucauccaagguugucucuccaaugaccuuagcagguucagaauaacccucuaauauuccucauuuacuguaguugcuuauuaugaacccaccaacuauuaauucaaucuuuuuugaauucucaguuuucaguauauuucucuucaggcugugguacauaucacaacauauaguaauuauuugcuauuuucugcuucccugucuagacuuugaguaaguugaggguagaauuuguucuauuucauaaucuuagaauuugacaaauagcagguauucuuaaccauaauuuuguugaaggaaggaaucaaugaauaaaaauuuccugaguuuacuguuuacugcaaaaagacuguaugcuguuuuacguuuucuucuuuuaaggucuaacaucaauauguugauguuugguaaauauaauuucaaucccaguugcaucucugaguccaggcaagaguacuacaaaaaguauaaauagaggucaagugcaguugcccucugcaagcaagaccacuuagaacucuucaauggcucuuugacaaaccuucagugggauuucugucaaagcugacaauggauaaaauuauagaaaggagggaaagccuugauaaggaguccuuaaugaguucgucacuaaguuaauucaacauugaaagggauagaagauguuaauuccacacacacgugaaagaaaucaacaaucaggccucaucugagagaaccaugauggggaaggcuggggcugauggaugaggggugugaggcagggcagaaagccuccacguugcugcagcaaugcaaaaauaggcaccuugccguaggccucucuggcacuccaucuugucucucuucccuggagaaaaggcaagcuguauucaaucaucuuuucaaugcuaaaaccaggcuuuccugucggaguuggggccagagauguuuccauccccucuugcaaaaaggguauucuuaagaggccuuaagucuucagcauugauaguuucugggaacaaaauagaaaucaaaaucucaccuuguguucccuuccucuuccuggacagagaaugggacaggcccaggccauccagaucacuaugaaccuuaucagaaacuucaguccauuuucuccguucccuucccugggacuugcaugcuauaaucuccauaccccuccuuccccacucuccaggcuuagugggugaggcagagagugagagccaggcuuaccugccuuuucuccucagugggaagaagcucaguaacugagcucagacgcuaguggcauaccuaccaagaggaugacauaaaugccuccuguggcccugagauaggcagagcucugcuggcagcccaaccauauguucacucguucauuaacaaacauccacagaggcaggcugcucuggccuggagggggauguccuacacuagacgacucagguucauagagccaggccucauuccacccccacuggcucaagugacuuucuggugaccagaaacuggagagcucuuuuuuuuuuuuuuagacggggucuugcucucucgcccaggcuggaguauacugacacaaucucggcucacugcaaccucugacucccagguucaacugauucuccugccucagccucccaaguagcugggauuacaggcgagugccaccaggcccaucuaauuuuuuguguuuuuuaguagagacgggguuucgccauguuggccaggcuggucucaaacucccgaucucaggcgauccgcccgccucagccucccaaagugcugggauuacaggugugagccaccaugccuggcccagagcucuuaacuacaaugacuauaugcagaagaacaaacuaacacggaagauggcuaggaacugcguaagccaagacucugcaguaagacacacuugaguucugguccucacucugccguuuacucacaguccaacugcagaugggaccucaccucucugagccucaguuuccucauuuguaaaauaggcaaauauuggcaccuaccucauagaauuagugcgaggcuuaacugaggugaucuaggcaaagcacuuagcuugguaccuagcacauauuaagugcucaauaauaggugauggugaugauguaaguuggacacaagagaaaaggacacauacuaacugauaaucacacagagccacugacuggauuugguaucuuucucugacauucagcuuuucuuaccaucugucagcaugccacacuccuucagccuugaauuauaugcugccuugugguuuugcucuuauaaaacaaauagaauguacuagucuuccuguggcuacugaaaaaaaaaaaaaaaaagaccacaaaccagugauuuacaacacagaaaguuacucucucacaguucugaagaccagaagucugaaaguacuauguugucagggcugugcucccuccaaaggaucuagggggugaucuauuacuuacuucuuccagcuuuggguggcugucagcaugccuuggcuuguagcugcaccacuccaauuucuaccuagucuucuuaucaucucaucugugucuguuuucuccucagugugucucuuauaaaaacacuugucaugccagacaugguggcucaugccuguaaucccagcauguugggaggccgaggugggcagaucacuugaggucagggguuugagaccagccuggucaacauggugaaaccccaucucuacuaaaaauacaaaaauuagccaggcgugguggcgggcuccuguaauugcagcuacucaggagguggaggcaagagaauugcuugaaacugggaggcggagguugcaaugaacugagaucacaccauugcacuccagccugggugacagagcaagacuccaccucaaaaaaaaaauaauaauaauaacuuggcuaauccagggugaucuccucaaaucaagaucccuaauuucauuacgucugcaaaguuaacauuuacaguucuggaaauuaggauguagacgucuuuuugggaaccaucuaucuuagacuguucaggcaacuauaacaaaauaccagaugcuggguagcuuacaaacaacaaacauuuauuucucacaguucuggaggcuuggaaguccaagaucaaggcacuggaagcuguagugucuggugaggucuuuuaacuauguccucauugcggaaggggccagggaucucucuuccuuuuauaaggcuucuagucucuuuuuuuucuuucuuucuuuugagacagggucucacucugucccccaggauggaguacaguggcacaauuuuggcuagcugaaaccucugccucccaggcucaagugauccucccaccucagccuccugaguagcugggacuacaggcgcaugccaccauguccagcuaauuuuuuuuuuuuuuuuuuuuuguagagaugggguuuugccauguugacaaggcugccaggcuggucucgcacuccuggccucaagcaauccacccaccucggccucccaaaguguuggcauuauagguaugagccacugcacccagcuucauucaugaagguucuaucuucaugaacuaaucaucucccaaauaccaucacccugggggcugggauuucagcauauaaauuuuggggagauauaaauauucaguccauuacaccaacauuugguccacuacuuggaguaccuaagaacauggacuuuagaaguagacugaccuggauuccaauaccagccccaccaucacucacuaguuggaugaccuugauucaguuauuuaauaucuuugaaccucagcuucuggaaaagggccaauaaugccaauaaugcuaugucccgggguuguuugaaagaauuaaauaagcuaauauguuaaaaguacuggauaauugguagcucucauuacuagugguagguuuaccccacuagucuacaagcucuuaagagcuggaguuaucucugcuuccuucacaagucuagcacaagucugcaaacagucuauccuuagugaagguggggugacaaacuggcugaaccaguggccuagacagccaauaucaccaauuauguaagauuccacagggaucuaaaggagcgaauuagaggcacccaauagugaccccaaucuaagcagugcagggaucagcuggguggguuugucagcagagaacagggccaccagggcaggcacauagaacuaacugcacucacugcacuguuguuaacuauucuuugaaucccuccacaugacgccauuccuacagauggaaggucagcuacacuggagaaguuccagaaauucauaaauagauuaugaucccaaaucccagagaggaggacuuuuccagauggcaacugggaauuuaccuuaaugauuuccccaucccagaagggaaagcuguucugguauauuacaaacauuacagcacaucugaauaacccagagagcuuguuuaaaugcacauuuuugggccucuaccaggcugguuaaacaaagcuucaacagaguggggauaggaaccaaccauuuuaaauaacccccuuugguaauucugguucaaccauagcaaucaaauuauaguccaaccuagguaggggcuugcuaccuaggagucaauauguaauacuggaaagaguaagaguuuggaaacuaaacagaaauaggguccaauccugggucguccacauaauagcugugggaccuugggcaaguuacuucauuuuuuuggaucucaacuuccucuucuauaaagggggggcuauaccugucaggguagugguguuaauucaaugauaauuauguaaagugccugcucauaguagauugaagcagagacugcuacuauucaccaauccauuucuucuucuuguucauacacaacuagacuauauuucccagcacccuuugcagccaggcacggccacacuaguucucaccaaggggauaugguucuaaguuauaguaccuauucuuggcaaaggcuuaaggaacagauaugccuccuccagguuuucuuuugucuuacaucacuuggaugcaggugacagguucuagggaacuggggaucuacaacauggaaggagccuguaugccugaguuacuagguaggggaaagcuauccaucaacuagaaugccugccuuggacucuucugcaaacgagaaauaagcucauauaccauauuagguuauaauauaguugcuuuaaagaaauacccauggccaggcgugggggcuuacaccucccagcacuuugggaggcugaggcaggaggaucacuugaggccaggaguuugagaccagccuggccaacauggugaaaccccaucucuacugaaaauacaaaaaauuagccaggugugggggcaggcgccuguaaucccagcuauucggguggcugaggcacaagaaucgcuugaacccaggaggcagagguugcgugagccgaguuucaggcugcacuccagccugggggacagagugagacucugucucaaaaaaagaaaagaaauaccugcauugcuauaaagaaauaccugagacuuuaauuuauaaagaaaggaguuuuggaggcuuuuucuuuuuuuugagacagaauuucgcucuuguuguccaggcuggagugcaauggcgcgaucuugacucacugcaaccuccgccucccagguuccagugauucuccugccucagccuccugaguagcugggacuauaggcaugugccaccacaccuggcuaauuuuauauuuuuaguagagaugggguuucuccauguuggucaggcuggucccgaacucccaaccucaggugauccgcccacuuuggccucccaaaguacugggauuacaggcaugagccaacgcacccagccaagaaaggaguuuguuuguuugucuguuuuuccaagaaaggaguuuuaacuggcucaugauucuacaggcugcacaagcaaggugcuggcaucugcucaguuucugggguggccuaagggagcuuuuacuuaaagccagagcaagcaucucacauggcagaguagaaucaagagugagaguuggugugguggugaggaaucucaggaugaccucccugagauugcuguccccuaguuauucacaaaaacucacugacuaucacaaggucagcaucaaggcgugaggcauccacccccaugacccaaacgccaggccccaccuccaacacugaggauuacaucucgacaugagauuuggaggggccaucuaaacuauaucauacacuuuugggaucuauuuuacaacuaaccuauagucaguguguuaauccauuuugcauugcuauuaagaaauaccugagacuggguaauuuauuuuaaaaagagguuuauuuugccuuaugguucugcaggcuguacaaccauggcaccagcaucugcuucuggugaggacucaagaaacuaccaaucauggcagaagcaggugugucacauggcgacagagagagaaagagagggggaggagaugccaggcucuuuuaaacaacuagcucucaugugaacuuaauagagugagaacccacucauuaccucggggagggcacaaaaccauucaugagggaucugcccccacgacccagacaccucccaccaggucccaucuucaacccugggaaucacauuucaaccugagauuuggaggggacacacauccaaaccauaucagucaggaaauguucacccccuuucuccaccuccaaauaacaauuacacaguacccagcaucugugcaaacauuuuauucuauucacaauucucauaugguguaaauugcaaucucucuguaguaggacaaauucuagggaugaccucuguauuagucaggcuucucuagagggacagaacuaauaguauauauauauauauaauaugaguuuauuaaauauuagcucacacgaucacaacgucccacaauaggccaucugcaggccgaucugauguccaauguuugagggcaggaagcauccagcacgggagaaagauguagagugggaggcuagacccaucuuucuuuucacauuuuucugccugcuuauauucuagcagugcuggcagcugauuagacugugcccacccagauuaagagugggucugccuuucccagcccacugacucaaauguuaaucccuuuuggcaauacccucacagacacacccaagaucaauccuuucaauccaaucaaguugacacucaguauuaaccaucauaaccucccugagaaacacaaaucuagguacuccugugaagggauucugcaaauguaauuaaaguuucaagucagucaaccuuaaaauacagagaugaucugggugauccugaucuaaucacaagagcccuuuacacaacagaaggggaauucggagagauuugaaguaugaggaagacucaagugccauugcugcuugaagauggcagcaccacgugagaaggaauaccucaaggaacugaaaguggcccuugccuaacagucagcaaggaaagaggaaccucagaccuacagcuguaaggaacuggauucagccaauaauuggaaugaacuuggaagcagauuuuucucagugccuccagguaaaagcucugcaaccaauaccuugauuuccagcccugugcuauuccugagcauagaaaucaggcaagccugccuggacuucugacuacagaacuguccacuaauaaauuuauguuguuaaauuuguggugauuugucacagcagcaauaaaaaaacuaauacauucucuuaaucuguuuugucaucaauuuuucuuugagacggagucucacucucuuucccagccuggagugcaguggugugaucauagcccauuguaaccucaaaaucgugggcucaagcaguucucccaccucaaucucucgaguagcuaggacuacaggcacaugccaccauacuuggcugauuuuuuuaaaaaaauuauuuuuuauguagagauggggucucacuauguugcccaggcuggucucaaacuccuggcuugaagagauccuucuaucucagcugggaggaucccaggaucccaaagcgcugggauuacaggcgugagccuccaugccuagcuuccucacuuauuuuuuauuaauaaaaagugacauggggagaugguggaaguuagagugaugauaucugaguaugcucuuagcuuuacauuugcucaguuccuugugcugaguugucuguuagggagcuuccugcccuuauagugagaaugugacauagucugggcaucagcugcagcucuuugaacagagaugauccagcuccccaucucaccagcccccaaauccaaaacuuaaaagcggagcugcugucaaggaaaacaaaguuaagcaaaaugacuucaaagcccaaugugcucaccuucacucucccaguggguccuugcaccugagaacgugcaggguccaucaguauugaccuccccuuuccaccagcccuggaaguuauggaaggggaagguagcuuauucugauaucguguccuguaauaaugcuuccuggccuggcacauauauccuuguuucugugccucuuguucuaaaacauccucccuuuccgaaagcugaaacuguuccugcacacauuaugcacuuaaccagguaaauuucagaagauuuuaaaaaguuucccagugaaggaaggagagagagguauuguccugagauacugaauaugcggauggccagacuagauaucaaaauagaacccugacccacaaucuguggcaacuagccugggaagccaacauauuaucugcaguaaccaauccaggaagcaaagcaauaacccccuuagcaauggaccccaaauggccaggacucgauuaauaaacugacagcucccauaauuuuugccccuaccuccaacuuuggacuaaccagagaaagccaaaugggcacccccaaccaaucacauagcaugccgcacuucuagcuggcccacuugcagcuuccccgugccaacagucucagggcacgcccaaaguguucccuuuuuucuaccacaaggcuuuuccacaccucugccugccuuuaagugucugccaaacacaagugaugguggcugacuaccuugcaaccucucuauaguaggcuuuguuuguucuuauuuggguggucuucauuuauuuccacaguccuuguuuuucagggagauuuagggcuuaaauacaaggaaauuucauguaaggaugcaggaguguuucauggaaccucaagcucaggaaagcugcacagccaugggaagacccuagagccggagucuggaaaagcaauccgagcuuggaucuuagaaaucuugucuucuugcaaaccggguucucugguccaaauggccaaaaacaugaccauggacagggccugugcuuaucucgucaccugcagagaggcaacucucuguacguccugauuccaaguuccuggagaaggacacagacugaaccaccuugggucaggcaccauccuugaccaauuuacuaacagugcccaacucccacccaggguggggaguaguugcagguagucuuguuuaugaacauggcaaucagaagcccaucccugucacuguguggaggggaggggagagaagagggaugguuccaaccaaaaaagguagggggauggacaucccaauagggguccacuccauuccugauggcacagugagacaguugucaugugucacgugcuagacucuugacucugugccucccaguaccugcuacugaccaacauggucuagugagcgauuuuucuugugaaggcauccauccauucauucauucauauagcaaacaauuguacaucacaaccuuaugcuaggugcuagguauacaaugauaaaacaaacacaaaaaccaaaaccacaaucucuacccucaaugugaggagauaccaccacauaaacgaacaauuacaauacugugaaacauguuaugcucaaucuauggccuaaaucagaugagaggcugggcagaggaucaggcugccaagaaaugcuuccuagagggcaugcugcccgaaaugaaccuugaaaaucagggagcuugauagaaauagggaaagagagaguguuucaggcagaagcaagguucacugucaaggaaaggcauuucaggaaaccaaaaguaguaucuguuugacaugagcuauauuggagugagaguacugggagguaggcuagaaaggggaacagagacuagauaugaaggaacuugaaagccguaaguauaugaagaaggcaaugggcuuucuacacaggaaugaccuugaagacuugauuugcauuauugaaagcucaccauggcuggaauggauuggggacguccgaugaugggaagacucagcugggcaguugcugcauuaacuguggaguuauaauggugaccuacgagagcagcuuuggauacggagaagagcaaacugguuuaagaaacgucaucaccugggucaagaaaaggacaugcaguggguuggguagggaggaaaauagauguaaauaaaguuauuaguugaaaaagaaaagcaagaucgagagagaaauuaauucuauugccaucuauucaugagaaucacaaggcugaaucaaaagccuuccugcaaaccuagacucacgcugguucaguucagagacucuaucagaaagaugaggagcucaugagucauccaucaaugugaucuugugauuuuucuugugaccacaagacaaaggaagagaagaguacuuuggagucauuaugaugaaaauucaguugaauacacuggaaagucaaaacgagaggagaaggaggaaccgaaaaucugauucagucuugaccaccaaguagaauugggacagaaacaauuaaguaggcacagauccaauuuggauuauaaaaagcugguucaucaggaaggccacuauaaaaccagaagcaaacgaagagucaauuaaguacaaaaguuuuuacuaugacuaugcagugagguccaaacuguacuaaauuugaaguucccugccaaagagaaauguaagcuucccuggugguauaagucagaauuucaugacaucagccagauaaccacaaaagaauauaucuuuuagugcuagaugcuucuaagccuuucuccacccaacuaaccaacauucacuuacugauuuacuuauuucuuuaacaaacacacuccauuucauagccacauucuuucaaagcugacagguugagauauaucuaaaacacaaaaucuccaacauacauuuucuucuucaauguugugagauguauuuuucuaaaacacuguucugcacauacuaccauuccaauauuaaaaacaaguuaguuauccacugccuuuuuuguacaaaugaaauucauaaauuuuaauuugguuacaaaaaaauuuuucaucaaaauuuuugcuuauuuguuuauauaaaaauggagacagggucucacuauguugcccaggcuggccucaaacuccuaagcucaagugaucuucccaccuugaccucccaaagugauaggauuacaggcaugcgauaccaagccugguauaauuuaaauuuuuaauuaaaaauuguuaauuugucuacaaaauaaauauauacucaucaucaaaaacuuucaaagaagaagauuaaaaucaccauaauuccaacacccagacacaaucacaaucacuucuguaaguuaggauauacugacagccuaugugacagggaaaaaacuaaguuguaagaauuuuuuaaaaaccuccuauuccccauuacaguagauuuuauuacucaaaauauuugcugccccacccuggggaagauaauacuuccccacuucauugcaucagccuuagagaugugguuugaggugucccuucuugugggaggauuacauauucucaucuccuugaccucaagaguggccaugagacuugcuuugaccaaugcaaugauaacagaagugaugugugccacuucgaagcagaagcucugauucaucauaugguucuacuauguucguucucucuuccaugaaaccagcaauaucccaaauacagacugcuggucccaggauggaaaacuuagagcaaagcuaccgguagcccacaaugugagcaagaacugaacuuuagucauuguaagccacugaggguuuuggaguugcuuguuaccacagcauaacuuagccgacacugacugauaccaccuaccuccaaaaugucaucugaguuuucuuuaugucugaagagagccuuuaugcauugaaauaaauacucccuuuaauuucaacuuauauuuuauauauuuaaauuauauguuuuaaaacuuaauuuugaagacuuuaaacuuguguuaauuuauaaaucaguuuuguuaauauuuuauuaucuacuuuuauuugguuuugaugaaugcccaacuggcuuguaaauuugauaagguacucccaaauauuuaucaaacuuucagaauuaaguuuuagacauuucaaacuacaaucuaauuuuaauugauuucucaaggaaaaaaacaacaaagcagacucacauuucuauaggcaaaaucuuaauaaacacugaaaacauacugaacuuaaaaaguuuaaccuuacaaauuuaauaaauuauaaauuuaaagauuuaacaauuuaaacauuugaacauuauuucaaacuuaguuaucaacaucuuauaaauuuuuacuaauauuuugagucuaaugaaucagucucuuuacuuaccuuaaaaagcagaaaaauauacacaaaauacuauaaugguuacaaaacuuauuucuagauaaaauuuaugacuagacauaacuuagcuugucuuccaagggucuuugaaaguauguuuguuuucuggcaauaagaagauauuuccagacucaucuugauauuuccugccguaaaacaugcaaugaauuuuucuccagggagcccagugcccucagggucuucuggcuggaaugcagauuagauggauuggcaaagcagcugcuggggccacaaggggaaaccagaaauccacaguaaucuuugaccugacguccuugagcugcugaaccaacaucccagguuuuuaagucccugugguccauuugucaaaugcaauuccuuacugauauaaugguuauacaaauaaagaagcccagagaaagcacugcauauggaaaggaaagauugaccuaaaggggaagaucuuguggggaggggaggcagugaagaaaagaggaggcaggaaagggaacuggggagagaggggagaucuggcaguuucugugaaagcaaauuaguaaggauuuuaagaaaaguuugccuuuauuccauugccauaauggggauuagaacaguaacauccauaggaucauugugagaauuaugccaagcacacauuaaguguucaauaaacauuggcuaucauuauuauuuuauuaugcugggccuccagaauggauuagaguugcagacuggaacauuauaaggaaauccaggaaguccauucauucuuacucuuucccucccucuccucucuuccacaauugcuccucugcacagcuguuuuaauccuauaucuuucugcagauuggcuuucuuucuaugucugugaugcuuaaaacagucacuaacaacaucuuucaaguuuccaaacuccuugguucaagacagcagccauuucgaagaaauuuccagaaagacacugauuguccagcuuagauggaaaguccacucuuggaucaauuaacugaagcuaugacaggagaguuguauggaaaacacauggcugcuccuacuagaaaacuucccaaaauaugaaggagggaaaagcagggaggaggugccgcugugaagacguaaugguagguaaacauuuggguacauuuccuuuggguccaugugcacacgaguacguuuaugcaugugugcauaacuuggauagcacuguauauagguuuuguuuguuuguuugauuguuuuagagacagggucucccucugucacugaggcuggagugcagugaugcaaucauagcucacugcagccuggaacucaucugcugcacucaagggaucuucccaccucagccuuaagagcagcugggauuacaggugugcaucaccaugccuggauaaguuuuaaaacaauuuuuuuguagagacagggucucauuauguugcucaggcuggucuugaacuccuggccucacgugauccucccaccccagccucccaaguagcuggaauuauaggcaugagccacugugccuggcaacagcugucuaaauuauuuuuuacaaggcauucagaacacauucaauaagauauuuuucuacagcacuguauuuauuagcuagguuaacauuuccauauauagauguucuaagugaauuuaaauuauuucuauuauuuugcuuuuaugaacucuauuugagugauauucuuguaacugaauaguugaaacuauuauuaacuccuuagggaaauuccuuaaauuggaauugcgaggucagaaggugugucauuuuuuaacaguuuugauacauuuugcuaaaugugccaggcaauuuaagccacacucccaccacaacauacaaaaugcagucuuccucaauaucgucuucagugcuuaguugaaaauuaaucaccauuugauaagugaaacaaaauuuccuuaauuacuaguaagauugaaggauaguuucauguuuuuuugaccaacuguuuuucuauuauauucuuauugguuuauaagagcauuuuagccggacuugguggcucaugccuauaaucccagcacuuugggaggccaagguggguggaucacuugaggucaggaguucaagaccagccuggccaacaugaugaaaccccaacucuacuaaaaauacaaaaacuagccgggccugguggcaggcaccuguaaucccagcuacucgggaggcugaggcaggagaaucacuugaacccaggaggcagagguugcagugagccaagaucgcgccacugcacuccaaccugggcaacaaagcgagauuccaucucaaaaaaaaaaaagaaggcauuuuaauuacuaaauauauugcugguugugguggcuugugucuguagucccagcuacuugguugaggccaagaguuugagccugggcaauacaacagggcccuaucuguaauuacaucuucccgguuugucguaaccuugauauaauuuguuuuaaguucagauacucaaaucucuucuuuccagcaccuaucuuuaucuuuccauaugccuagaaggauaucauccacuaucuaccuaaguaucacccuuuccuaugucccauucccuaaauagaguuuagacauuucaauuggcauuuaaaaguccuucacaaggcacuacgaugucuuguuuuucacuacugccauccacaaaucuuucuuuuauccauccauuuguucauuuauucauuugucaccuauuuacuaagcaccuauuauguaccaggcaucauucuagacacuggggauacaggagugaacacaucccuaccccuaagggagcuugaauuuuagugccacugaagacaaacugaaaagguaagaaaauguauauaguuggcuggauggugauaaguacuauagaaaacaauaaagcaguaaaguaggguaggaaauucagggagagagugaaaucuuacauagaauagucagggagaacuucacugaaaauguaauacauauuugaggaagagugugaggauggugacugauaugguuuggcugugucccuacccaaaucucaucuugaacuguagcucccauaauucccaugugucaugggggggaccuggugagagguaacugaaucaugggacugggucuuucccaugcuguucucauagugguaaauaagucucacgagaucugaugguuuuauaaaugguagacccuacacacucucuugccugccaccauguaagacaugacuuugcuccucauucgccuucagcuaugauucugaggccuccccagccauguggagcugugaaucaauuaaaccuuuuucauuuauaaauuacccagucuuggguaugucuuuauuagcagcgugagaacagacugauacagugacagaaugggccaagugcuauccaagggagaagcauuccaguaugggaaagagugugugcagagagccugcgggggagagggggaaggaggagcauaccuccuggauuugaacaccagcaaggaagccaguaaugcuggaacagagugggcaaagaggguaguugaggcagggauagggaaugggucaugcaggguuuuguagaccacuguagagucuuuggcuuuuacuucaaaggaaacgggaagccauuuugagggugugguaaauuguguuuccaaagauggcagcagaaauaucucacaccucacauagucuuuugcaaugugaucuugucacuguccuaagaagagauggggucucuuuccuuuuuccuugaauuugggcugagccuaaaccaauccugacgaacagaaucuaguucuguaacuagauucuguaauacuguaaauuccagacugggccuuaggaacuguuuuagaagccuuccuuucaccgcuugaaaugcuccuucuuggaacccagaaggcauauggagaaagauacguagaagagaaccaaggcccagccauuucggccuaguugagcauuucugccagccccuagcuuucaagccagccaguugaagccgcggacaccagauaacagagaugagccauguucaacaugcucugcacaaauuuuucacccccaaaccaugagcaaauaauagcaauuguuguuuuaaaccauuaaguuuuagugugauuuguuacugaugacaaaagagacaaauagagaugaacuaaauagcacgggccacaggggaguaggcacgagaccccacaguuacuuuccugaaauuccuagacccccuccugcuucuguaaggaacuccaggucuggguuaaucacaaacugaugacuauuccaagaagcacuguacuccuuagcuaaucaucuguuagcuuauuucuguuaacuaaugguauuucuauaugaacaugcugagaccaccuuguuguaucuccucauguuguuccuuaaaaucugcuuguaaccaccccaaccuggagcaccuccuggacuugguauauaagugcuucccagguugcaauccucaaauuuggcccaaauaaacucuuuaccuauaugcauuugccuuaguucuuuuuuuuuuuauuuccaccaugccuggcuaauuuuuaaauuuuuuguagagucaagaucucauuauguugcucaggcuggucucaaacucuggggaucaagugauccuccuaccucggccucccaaugugcugggauuacaggugugagccaccgugccuggcccuuaguucuuucuuucagauugacauuacacagcaauaggggacuggaauaaaaauuggcaccagaacaugaaauacuacuggaaugaaaaccuaaagccaauugcuacauguuugggaccaaguaacacauagaagacugaagagcagugagaaggcuguuggugucuucacaugguuugauauuugucccucccaaaucucauguugaaauguaauccucagcguuggagguggggccuggugggaggugucaugguugcagaucccucauggcuuggugcugucuucgcaauaguaaguucucaugagaucugguuguguguggcaccucucccuaccugcuccucuucuugccaugugacgugccugcucgcacuucaccuuccacagugaguaaaagcucacugaggccucuccagaagccgagcagaugccaguaccaaugcuuauacugccugcagaacuaugagccaaauaaaccccuuuucucuauaaauuacccagucuuggguauuccuuuagagcaaugcaagaaaggccuaacacuagccuaaaacagggaggaaaaacuugcucuugcucuugugggcuagagaaaagggggccugaguuacauacuggcagcucaauuacacugucacuuguagcaauguggaagaugguacauguguucaugaacuggcuaaggacauuuucaugcagagugcugaaaaugccaaguggcuuguaauaguugauaauguacagaaagagauaaacuaaagagggaaauguucaccuuucaagcaaauuuuagaagaauauagagggcccaagacugucugagucaguuagcagcguguucuaaaaucaaaauaaaacuuggaggcaaagaacaaaucuaagaugcuguaaccgcccaacgaauuuuccuugcccacugccuaggcagacucaauuuaagacaggggaauuacaauaaagaguuuaauccacacacagucaucuguacgggagacuggaguuguauuauuacgcaaaucagucucccuaaagacuugggaugggguuuuuaaggauaauuuggugggcagggggucagaaaguggggacuacugauugguuaggucagagaugaaaucacagggaguugaagcuguccucuggugcugagucaguuccugggugggggccacaagaccagaugaaccaauuuaucaaucugguuagggacagcugauccaucgagugcagggucuccaaaauaccuguuaucuggaggagcaauuuggagggguuuagaaucuugccaccuccagcugcaugacuccuaaaccacaauuucuaaucuuguagcuaauuuguuaguccugcaaaggcaguuuauaguucccaggcuaaaaggguguuuguucagggaaagggcugguaccaucuuuguuucaaaguuaaacuauaggccgggcgugguggcucacaccuguaaucccagcacguuggaaggccgaggcaggcagaucauuugagaucaggaguucgagaccagccuggccaacauggugaaacccugucucuacuaaaaauacaaaaauuagucuggcgugguggcgugcaccuguagucccagcuacucaggaggcugacgcaggagaaucguuugaacccaggagguggagauugcagugagccaagauggggccacugcacuccagccugggugauagagugagacucugucucaaaacaaaacaaaacaaaauaaacaacaacaacaaaaaacaaaguuaaacuguaaguuaaguuccuuccaaaauuaguucagccuacacccaggaaugaacaaggacagcuuggagguuaggaacaaaucaguaaguuaggucacaucucuuucauugucauaauccucucaguuauaauuuaugcaaaggugguuucgaugccacaaguaaaacguggccucuggucaacaugaggcccuuuguuaaaaucccagaaagauguaaggaauugcuucucaaacccucaugguuaguuagacaaacaggcuucugaaagaacaaguguguucucacacagcacccugacaugcaccccagagagggagcguaucuuaaaaagauugguggagaugguuuuuaucuaacacagugaaucccaguaaaauccacagaaaacucacaauguuuuuaagagaacugaacuaacacaagcaccacuagcuuggacuaaaauggacaaagacuguucaaaacaaagccacugggcuccuaaccauuuacuggcaggaaauaggcugaggaaacuauuuggcugcaaaucaggguuuuuguuguugagauagggucuccuccguugcccaggcuggagcacaauggcacaaucacaacucacuauaaccucugccucccuggaguagcuaggacuauaggcacaugccaccaagcccgccuaauuuuuguauuuuuuguagagacgggguuucaccauauugcccaggcuggucuugaacucccagccucaagugauccucccgcgucagccucccaaaauguugggauuacaggcaugagccaccacgccaggcccaaucacgcuuuuucaaauaguaaaggaaggccgacccagaagguggaguuaggaaguaaaucagguccagcuguguguggauaaggcuccacagggauggcucugugggugcagggacccaagaacuaaaaagacaaguuaucugccucccacauuccuuguacaaugugaggaggaaaaagauaacuacaauagagaaucccuuucaaaaaguaaggaugaguguaugaaaucugaauaagguuugcagugcaguuuaaacaguucauaguguccagugcuucugauaggucaaguaaaguaaggacgauggacguggcaacauggaagucacccaugacuucgaaaagcaguuuucaauuuaagugugugaaagcuuuauuguggcgaguucaagugugaauggaagagaugggggcaaugauagaagcauaguuuuuggaucuuccugaauugcuacauaaaaauagcaacuagauagcacaaucaaaaaucaaaagcugggagagcugaagacuaucaguaucuaugugggaagaagcagagggaagaaaaaaaaaaaagcaaaugaugaauucagagucagaaaguaggaugacgguugccacaggagaggggaaguggggaacagggaguuccuuaaugaguuguuuugcaaauugaagaguucuggagauuggcugccaaauaaugugaauguucuaugcacuuccuacuacugaacuguacaccuaaaaaugguuaagugcccggugugguggcucacaccuguaaucccagcacuuugggaggccaagagagaaggcucacuugagagcaggaguuguaggcccaagcccucgggaggcugggguggaacaaucacuugagcucaggaguuggaggcugcagugagcuacgaucacaccacuacacuccagccuaggcaagagaccucgucucaaaaaaacaaaaaaaaaugcuuuacucuaauucucauauaucaggacagggugucaccagcauaagggcaggaaaaaggaagugcgguccacagcuuucagaggaagaagacaagcucgggguuucauauuuauauucucaacaauuagcacaacaaugggagaaggaaugucuuuuuaauaaauggugcugggaaaacuggauagccacauguugaagaacggaauuagacuuuuauuucauaccauauuaaaaaaucaacuuacaaugaauuaaagacuuagcuguuaaaacccgaaacuaaagcuaggcaacaaaaauguagacaagauuacaucaaacugaaaagcuucugcacagcaaaggaaaccacaaaguuaggagacaaccuacagcaucagagaaaaugcucgcaaacaacaucugauaagggguuaauauucaagauauauaagaaacucaaaacugcucaauagcaagaaaacaacccacuuaaaaaguugacaaagcaccugaauagguauuucucaaaagacauacaaauggccaacagauacaugaaaaagugcucaagucaggcugggugcaguggcucgcgccuguaaucccagcauuuugggaggccgaggcaggcagaucacuugaggucaggaguuccagacgagccuggccaacauggcgaaaccaucucuacccccaaaaauacaaaaauuagccaggcauugugacaugcgccuguaaccccagcuacucaugaggcugaggugggagaaucaccugaaccuggaggcugacagagguugcagugagcugacaucgugccacugcacuccagcugggguggcagacugagacccugucucaaaaaaaaaaaaaaaaaaaaaaaacaaaaaaaacaccuaaaaaccugaaaguagaaauaccauaugauccagcaaucccacuaauggguauauacccaaagggaaugacaucaguaugucaaagagauauccauaccccuauguucacuguagcauuauucauaauggccaagauauagaaucagcccgaguguccacaaaugaauauaaagaauauguggccaggcacaguggcucacaccuguaaucccagcacuuugggaggccaagacaggcggaucaugaggucaggaguucgagaccagccuggccaacauggugaaaccccgucucuacuaaaaauacaaaaauuagccaggugugguggcggccaccuguagucccagcugcuacucgggaggcugaggcaggaaaauugccuugaaccugggaggcagagguugcagugagccgagaucaugccacugcacuccagcuugggcgaccaagcaagacucuaacucaaaaaaaaaaaaaagugagcugggcgcaguggcucacgucuguaaucccagcacuuugggaggcugaggcaggaugauugcuugaggucgggaguuuaagaccaacccgugcaacauagugagacccuaucuguauaaaaaauacaaaaauuagccaggcuugguguuguagccuguggucccagcugcucgggaggcugaggcaggaggauugcuugaguccaagaagucaaggccaaaauaagccaugaugucacuguacuccagccugggugacagagugagacucugucucaaaaaaaggaaaagugguauauauacacaauaaaaaauucagccucaaaaagaaggaacuccugcaauaugcaacaauuuggaggaaccuagaagacacgguuaaguaaaauaagccaggcacaaaaagacaaaugcuucaugaucuuacugauccaugaaaucuuaaaaagucaaacuuccuaaguuugacuuaagagaugcagaguguaaaggugguuacuaggggcuggaggugggggacugggcgaggggggaguucagggugauguuggucaaagaacacaaaauaucagccagaaguucaggagaucuacuguguaacacggugacuagaguuaggaaccuggcacuguaccuuaaaaauucugagaguaggccgggcacgguggcucacgucuguaaucccagcacuuugggaggcugaggugggcagaucaccuguagucaggaguucaagaccagccuggccaacauggcaaaaccccaucucuacuaaaaauacaaaaauuaccugggcaugauagcacaugccuguaaucccagcuacucgggagguugaggcaagagaaucgcuugagccugggaggcggugguugcagugagccgagaucgcgccacuguaccccagccugggugacagagcaagacucugucuccaaaaaaacagaaaaaaaaaauuacugugaguagauuuuaaauguucucagcacaaaaacaugagguaaugcauaugcuaauuagcaugauuuggcuauuccugaauauauacauauuucaaaacaucauguugcacaccacagauauauaucuuuuauuugucaauuaaaggaucagcauagacuccaugaaacuugagagaccugauuaacaucugaaggcaacaucucugcaaaacaacuaacuugaguacuuuaauuauauauguaucuagcagaagagaaaaaaacaacacaguuuuaauuuuaaauuuuauuaaaguacagaguuaacaaguuuugaguuuuuuauauaggaaaagccuagucaauucagaugcuuucuagaaaaauuaacauuaaaaaacaaauagaaauccaugacuaaagggggaaaauaacuuucaaaaguuaccaaaauucgaaucauaucagagaccauuauaaauuucaaacaguagauuuaccacacauauugcauuuucaaauucuaauguagcaaaacguaaccacauaauuuggcuacagcuaaucguuucagaaaaguuuaaaaaauuagcaaaguuauaucuauaaaacuuuuguaguuuucuuuuugcaaaguaaaaaggcuuaaaucuuuaauaaaggaaaacaaaacaauccucuuaaauuucuuauaaauagcucuccagacauauauuacaaaucugcuguaagcuuucuuuaccugagagaacuucccaggauccuuuaucccaaaggauuaccuuaaagaguucuuccaucauuuuacucaugugaauaugauuaaacuccuauagaaguggauugggacauaugcauucuuaaucugcccuuccccauuuguuucuuucugaaaggauuuugcuuaaggaaaaaaaaagcucuuugguaaaggccaaauauuucaaccuuucaaaaugacugccucugugaaagaguuguugagaaagaagaaaagagagagagagagaaaggucuaaacaucugugugaacagcucuccaguacugugaagucaaaggcccaacauuacagagcgcaccucugccugaaauacaaaacuaaguuaacuagcaaguuacaggaaauagccuucaguaaauuccacaagccaaguggcuacugcauugucccugaagaaggagggcccaguguucuuucuggguguguaaggucuuacuuaguucaagguuugucccuucuuaguuguagguugggcccucuuucguuuccaagagguauaggacacuagaguacaccaaaugagauacuauuuggaaaggcaauaaagggaguguaaaagccuagguagcuuaaauacaggcucuggaauuuccuucgcaggaaggugaagcaccaaugauggcaaaaauuaaauaaauacaucaucuuaaaaaggcagaggguaggcugcgugcagugguuuacgccuauaaucccagcacuuugggaagccaaggcgggcacauugcuugagcucaggaguuugagaccagccuggacaaccccaucucuacaaaaaaauaaaaaucggccaggugugauggggcaaaccuguggucucagcuacuugggaggugguccuugagcccaggaggucaagccugccaugagucaagaucaugucacugcacuccagcguggcugacagagugagcccgucuccaaaaaaaaaaaaaaaaaaaaaaaaaaaggcuuagggugacaauuuugacauggggacaggaaauuaacauuacacugagguuauucauaauaaaggaucuucugaggaaucggaaauaaacaauguuguauggaaacagaaccccaaaaccccaauaacuccacccuccccacaacccacccccacucuaucuccccuucaaagaggcuccaaauaccucuggcaaauaauuucuuuuucagacaaaaugaagaaccuuuuugcccaagaaacugugggcaaaaauaaaacuaaccaaucaguauuuaaaaagcuagacacaguaaagacgugguuggguuucugaaggcuuauaauggaaauagucucuagucuccagucagguaacaugccgcgguaugacacucccauaagaacccccaccccccugccacccacuuaguguuuuuacucauaaaaaugaggggaaaacuuuucuacaucagacaaaucacacagaggaaauauucacaugcagcuuuaaaaaaguccucuucaacugucaucccuaaaugugucugaccagcagcuucugggaauauacucuuuaggucauguacaaaaagguguaggaagcaaaugucuauuauuuuuaaaagauaucagugaguuaaucaaauuaacaccguuguuauaggaacucaaagccauuggcacaauguuuccaguuucucaaaucacaauugcacaaaacuguagauucuuuaaauccaggaauguugacuccucaccugaguauuguauaucacaauuaauaaccauuaacauuaacucugcauugauagucccucaauccucagauacauccacaucuguuuuguucauccagauacacgugcuaacauuuucagcugagaauaaaauucagagcaacuguaacucuuccucuugcaucagaccaaccggcagaagggaacgggaugucacaaaccagacucacgcaucuggaaaacguuguguggcugggcuggcuccagaaggaagcgacgagggccuucuaccggccacacucccuugcuugggcuucccuaagcugcuuucugcagaggaaagggccaaucacggccagccaaggaauacaaggccuugucagcuggaccuugacugcgcguaaggucaguuucucaaaucacaccagcuggcagccagacccagccgagaggacaaagcaagggcucugcuagaccucagcaggaggaaaacaaugaaacuagucacaauacugcccaggcucuuuaccugcuuccccucaggguguuuccuaaagacaacccccaaggcccuaggccacugcaacacagcuacugugugugacacgcagccccacucccugagcccauuccuggcccacggaacuccuguccccuaacugauuccucagguuagaacacggcuuuucauuuugcgacuccagaugaaucuuuuaacugcugaguacagagcuccugcccuaaaaaaggaaauuuaauggaauuuacaaaacaaggcucucuaaaccacacacacagauggagugccuuuugaaacugaaucucaaacacucuaaguagggaaaguucuaaaggaauucauccccuguaauuuguuuccccauggguuuucuugggagaagggcaaaggaaugaauagaaagaauuucacuaauuucacccaccagcauuuuggcacacagaagcccagcuuagguggcacucaauucugcccaacucauacaguagggcacagaaaaaaaugacuaggcugagccuuuuauucuuagauccucacuuacagagagcucgagaagauucuuuccaccccgaaugaaauucuaacaggaguuuccaccaaguaaaccuuuucccugccugaauacaucaacacugaaaauaggcaucaucuuggguagcugccgaaagucacguuucuguauuacuuugcaaguacguauuuuggaaauuccugugcagcgugaucucggcucacugcaaccuccgccucccggguucaagugauucucaugccucagccuucgaguagcuggcauuacaggcacacgcuaccaugcccggcuaauuuuucuauuuuuaauagagacaggguuucaccauguuagccaggcuggucuugcaacuccugaccucaagugauccgccugccucugcgcaccucuuuuuaaguauauucggccacuuccacacauugccuaacaagcuucuucuggucagugugucugagauccucaccucagaaauucucacauuagcaaaccuacuccaaggaugccagcaugaaccugaacgguauggucacguuacagauccagaacacaaaacgacuuccgcuuuuacaguuucaaaggccucaagguggagaaaaaacugaggggcugaccucaacaacugaaagagcagugcaugcagcaggcuucaacacgaagcagcuuuucaguuaagguccuaaaaguauuaucauuaucaacagcacaaacaaguaagaaugauagcccuccauugcuuaggcagagaaaacaugaaucuuguucuauaaucaugugaauaacaccauaaauaagcgccguacuuauugcaguaacucggaucagguagugauaauaagguggggaaccaccuggggggugaucagacaaauugugcuuuuucacauuauuacaaagaugugggacccagaaaagaugagaccucggggaagggugcaggcagagagugaagucugugauucccagcaucacaaccucaaagggaaacguuuaggggccgugaagaggcagcacugagggugcaguugaaaagcaggugccuccucuuggacccuauaaauaccaggggcccugcaggcugaguccuguccucaaagcccccuggggacaaggcucuaagaggcggaagugagugagaggggucuggauucuguuaggcgcuggggacucaagauuuuggcauguuuuucuauuccgaggaugagaaugacuggccccacaagauauuuuuaucccugugaaaagaugcugugccccaaauucuguuuuggcaaaaacaugcagaaggaagucaacauaacugguauccaguuccuagggguaagauauuucaaccaugaucaguuugguugaaaauuucaauuccuuugggacaaacugguaguuucuuuuugaauuucaaaaguaaaaagcuaaucaggagauuuuuuuuuuucucucucaaagcuuuuucagacccacucaggcacagggcgccagucccugccccggggacacuguucaaaagauggcacuuuccaggcuguaggcccacaaagcccaggggaccgccgauaucaucacacagagaacucccggguggggcagcagaggggagcgaccagcguacacagguacaacagcacgcauauccagcaggaggccaucuugacccagaagauggaccagcucccgcugaagaagcucucgauguuggcacuuucguagcuguggaaacaagacaccuagccgcggucaaagcaggaauauauugagauacaauucacuaauucacauccauuuauaauguauaauucaacggcuuucaauguauucauacacagacuugugcuaccaucaacacuacccauuuccaaacauucucaucacccccaaaagaaaucaugcaccccuuaggugcucuccccuuccccauggcccccucagcccaccccccgcauucaccaaucuacuuucugccucuaugaauuugccuauucuggacaguugauauaaaaggaaucacauggucucuuguguguggcuuuuuugccuggcauacaauuuccaaggcucagccacgcggcagcaugugucaguccuucauuccuuuuuacugcuaaauaguaucuuauuguauggauagagcacauuuuguuuaggcagucaccagcugauggucauuugggauguuuccccuuuuugauuaucaccaaugaugcuuguaugaacaccgcuguguaaguuuuguggaccuaguuuucuuuuugucuuagguauacgcucaggaguaguggaagagcuggauuacauuguaacucaauguuuaauuguuuaaggagaugccaaacucuuuuccaaagcagauuucacauucaaaccagcaauguaagaggguuccaauuucuccacuuccucgacauuuguuauuaucugccuuuuuaauuauagccuucuccaucuuuucuuaagcuuuccaagccaaaaauucccaggaguucccaaagcaucacugggaagcauuaaagcucccuucuccucuccuccuucaggaagaaucucuccaaucacugugcuugaaaccaccacucccaccaccccuaccccaauucccucuccuaauuuuauuuuucuccccaauacucaucaccaucuaacacaccauauuugacuugcgucauagucugucucuccugcuggacuauaaauccugccucauagaaccguguggcacauaggagccacuugcacaucuguugaaugaaugauaaaaggaagcacaaugagccuacaugucuaagcuuaacuuaguggucaaaaaaauuaugauacaaccaaagcuguggaccuguagaaaaaguaugaaccucuguguagugccagggaaggccaggucaaucauguacugccaaguuaaaaaaaaaaaagccuccaggggaaaacauguauaaugacauuuauguuaaaaaaaaaauuagcuggacaugguggaucaugccuauaaucucagcacuuugggaggcugaggcagguggaucacaaggucaggaguucgagaccagccuagccaauauggugaaacuccgucucuacuaaaaauaauaaaaaaaaaaauuagccagugugguggcagcaccuguaaucccagcuacucaaaaggcugaggcaggagaaucacuugaacccaggggcggagguugcagugagccgagauugcgccacugcacuccagccugggugacaaagcaagacuccaacuaaaaacaaaaaaaaacuacagagguuuauaaaugcacagaaaaggagaaggauacacauccuagcagugguuaucugugugggggaaguagaggcggggggguaccacauuguuacuuuucauaauuccacauuuaguuuguauuuuaaaaaaagauguuuccaauuuuuguaaugaaaaugaagaaaaauggggaaaaagauacacaaaauuugaaguagaaaaaaaagggauauuuucucuuucugaaaggcagaugaaugcuuaggaguuccuauuuuuccuucauuaccauguuuuccagacuguccauauagagcuaacuuuccauuuucuuaaaguugccauaagcaucaccaguuuccaggguuaaaacauacccauccacuguuaaaacucagaacucgcuuguaaucccagcacuuugagaggccaaggcagguggaucacuugaggucaggaguucaagaccagccuggccaacauggcaaaaccccgucucaacuaaaaauauaaaaauuagcuaggcauggugguacaugcauguaaucccagcuacucgggaggcugaggcacaagaaucgcuugaaccugggaagcagagguugcagugagccaggaucgugccacugcacuccagccugggcaacagagugagacuccuucucaaacaaacaaacacgaacaguacuuaacucuuaacuuuaaggcuuugcuucaaaaauaccuaagcaaaugggccacucacuugaaccaguuggugacggucaucaucacauacagggaagcuaggaagaacacgaaguggaaguaggaguagauguagacggugccuuucuucucgucauaaaugacccguggucccuccuuccccggcugcugcucuucagugucugugaagcacagagggagcccaggcucaaugagugaauguguguguuuaccauucagcaaagucacgcucgcuaauucuacagggcugucaguagaaaagaugccagaaagccaucuguacccucuggcaacuucaaucugugcccuaagcacaaaacccccacuccacccuagcaacuuccguaacaggaagaguuaccuaaugccacauuuauuuuuauuuauuuauuuuuugagauggaguuucacucuuuuugccccggcuggaguacaguggcaugaucuugggucacugcaaccuccaccucccagguucaagcgauucuccugccucagccucccaaguagcugggauuacaggcacacgccaccacgcccggcuaauuuuguauuguuuuuuaguagagacaggguuuugccauguuggccaggcuggucucgaacuccugaccucaggugauccacccaccucagccucccgaagugcugggauuacaggcauaagccaccgugccugcccugccacauuuauuuuaacagaaagagaacccuuaaaaacccuuaaagacguaaaacuuacuauaagcucagcagaaagugagaguaaaacaagaguuaguucucaagcccuuggaauccuccaauccaccuuggaaaguaaggugaaggaaugaaauggccccaaaauaaggugucaggaccucuugguauuuuccaaaucacuccuuuuuaaaaaaugugcucucugauucucuaaaucucacuguauaauuuaacuuacauuuaaaccaaaauuuggacugauucucucuaccagaauaccaacacaaacaaaacucagcuauccuucaggaagaaugugaaaaguguauaaguaguaagucagcuuuagaauaaaacuuucuccuuacuauucaaguuauuugugucugaaucccaaaugacuacagauuagaguuauaggucugcagugccacacaggugcaaagaauaaaagcgcucugcuuacccucuccaccaggacugaagcaaaaacaacagcgagcuaucugugaaagcaaaagcaacagucaggcggcuuguguucuauuucuaguccaccucagcaagacaacaguaacccuuauuugaaccaccucccaggcccuucaaaagauguggacuguucuuucccaggugugcuggguguuggugacaggaaaccccauggagggagaugugccacagagauccucauccguggacuuggugcucgcuccugcuaccaugaaugcugagagcagagccucgagacaggagcuccuuuacccuuccuggguaacugccauggaauggcugaucauggcagggguaaaggccgugccuuuauggcuccuaggguuagggaggcuuuguccagcugcacuguccuucaacuucacccucugcccaauuuugccuccccuuccccuucucccucccacaugugcugacuuuuaauaaauaucccacgcaacaaacugccucagccucugcuucuggagaacucaaugugaaacccaaugaacgugacaagagccccacucuccuggugcucccuucucgugcuuugcuuucaauguuauuucauuaaacccucuuugaccuuugcauugggcuuauuauuauccuguguacagcugaggaaacugaggucaggcagguuaacuggccaaagucaccaaacuagcuuagugacagagcuggaacagacgaaugcaggauggggacaccaagauccaugauucacaauagguaacacgugguaucuaggagcuuggcgaagcugguaggaucugaaauaguaaagugaaggaaucuggaagcagccuacccauguuuccuaucaaaaucaagcuguugcacgggccgugggcagggauggagggaaugcuugccuuugaagcaucucugguaccuugcguauuuuuuauucuuuuuuuuuuuuuuuuuugagauggagauuugcucuuauugcccaggcuggagugcaauggcacgaucucggcucacugcaaccucugccuccuggguucaagcaauuauccugccucagccucccaaguagcugggauuacaggcaugugccaccaugccuggcuaauuuuguauuuuuaguagagacgggguuuuuccauguuggucaggcuggucucgaacuccaggccucaggugauccacccaccucggccucccaaagugcugggauuacagccgugagccacugcacccggccauuauuucuuaccuacucaaaacaauaaacuuaauuuuaaaaaaucagguuauguauagucccagcuauuugggagacugagggaggaagacugcuuaagcccaugaguuugaugcugcaguaagcugugaucccaccacugcacuccagccugggugacagagugaggcccugucucaaaaaaaaaaaagcaaagaaaaaaaguaugugauuucagaaggacucugguaaacagaguacuaagacagccugggaagugcagggcccuuagcacuuuguggcugaagauauuucaacuacaaagaacagagagccaaggauaagaauaugagagcuugagccuucaucucauuuguguaucaaggccaagcccuuguuucccugcuuggcaaggaaaccuuuaacggagguauuagccuuaacaggagcuuggauuaagugccauggucuaaaaaccacuaauucauucagugggcccaagacacgguaugcugaggucuuaguuauuuugaaguucaaguuaccauaagaaacuaugaacucucacuuucaaaguuguauccugugaaaugugacgcaggagagcaaaccaacuuccaucccgcaugcucuccaguucagaaggaaacacucggacauuuucccuuggacugagaagaaaaacauccucucuuaaaucuaacuuggagacuugcuguucuuugagcuugaacucuguacacaauagggacauugaaaccauaaccaugcaaccucagcagguggucaccuagucaauggugagaauaaacaccccuucuacagaccauucucuucucuauaauaggcaguaaccuauucaaacucagcacaauuuucuccuuuaggcaacagaaagaguuggugaaugauguuggcagaugacagcccuucauaauggcucacuauauccaggucaggugcaagagagaccaaccccagacacccagcugcagaguaaaaugcccauaucuagacagacaccagggcuuuuccauccacggaaagcuauuaaaacgcaggcaguggccagaaaccagcugcccgcagucagcagcaaggaccaggguucagcagcucagcuccugggcagcaguggucaagaacacagauccuggggccagaguacacgguuuauauucuggcaaaucaaaaccugugaggcuuaaaugacuuaacucuucugguuuuccccucuguaaaauggagguaauagcacgucacuggguuuuuaugaggauuaagugaaaucacauaggaagaacuuagaacagugccugggacauagcaagugcuguaagucuuagccaucuuuggaaccccugguucuuuucguucuugggucacagcugaguccuucccuggcugccuccaucugauuagaccuugcuguuguugguagaugagagccccagaaagacucuugcacaauuaagaaaauaacagacauuuuguugacugauaggcaucugcugaacaccuugaggcuuuggaugugcaggcaaccaauguauguauuguccauaacacucuaccugacaaaacgcccaccugauggaacugacaaaugaguuaauguaucuacaacguucaacagcgucaggcagagcagauaugguuccuucccuuuccucucuccuuucuuccaaacagcuauuacauaaucucacagccacgcuguguauggagggcacagacaaguaugaaacagguggguggaucagaaguuaaaauaaaacccaccaagacuccacuacggcaagggaagagcgcagggugcagccugacaagguuaccugagccucugguugggggugagcggcaggaugccacccaagaggccagcuuucuuacagaaaaucaagaauggacugauucauuuuaaucccauagcauacaaaggaaagcaggaaagcauuuauuuuucuuuuuuauuuuauuuuuuugagucaaagugucacucuauugcccaggcuggagugcagugguaugaccuuggcucacugcaaccucugccaccaggguucaagugauucucgcgucucagccucccaaguagcugggacuacaggugugagcaaccaugccuggcuaauuuuuguauuuuuaguagagaugggguuucaccauguuggccaggcuggucuugaacuccugaccucaggugauccacccgccucggacucccaaagugcugggauuacaggcgugagccaccacacccggccagcauuuauuuuucuauacaaaaaucuuuccucagcagaaaaacaggaucacggaaugcagacugauaaagacacaaacacaaaaggcccuccugagaaauggaucuucugagaugaagcaggacaggaaaaggaaaugaacuuaccuccaauucaggagcugcguaucgccccugcagagcgucagaacucgaucuuguuguugaugucaaacuaagaaacagacaaaaacgucagcugggcauauuaacacauuacaacacauggaaugaaggggaaagccggcuggccagugcuccgacgagagccucaauguaaccuaccguucaggagacuuaaaucaaagcaaucuauuuuaauaccucuccuuauuccaaaauuggcuggcuuauucuauaguugauaucauuuuacauggauugcauuagaucauuuuaugcaaagaagguuguagguagagaaguaagauaucuugguuuucaguauugcuuuuugccucuccucccucaaaugcuacaauaguuuucuaauuucaguuuaucuuucccucccuuugacuagucuugcuuagagggaaucaaaagcaacgagcccagagauggcaacagaaagcaagggcaugaaagcaaaagucgcaguuauuuacugugauagccuauaguagaacaaggcuugcuguuuggaagaguagcagucgagguaauaaaaaauucugccacuucccugagaccuagaaagguaaaauguuagacaaauugccuugcauggggcaaaauaauuuauuuuuccugaaaacaaaaacaggccagaagugguggcucaugccuguaauacucugagaggaagggguggaaggaucacuugaggccaggaguuugagaagagccugagcaacauagcaagaccucaucucuacaaaacaaaaacacagaacauuuuaagcaaauauauacaauacuuaggguuccagcuaacuuuacagauugauuuagcaaauauuuacugaaggccacuaugugucaggcccgauucuaagcacuggggacucagugacacaggcaacaauccugccgucauguagcuucugugcuggccugacaugggcgggcguguuggugcucaagaagcuggucugcucauggaaagguggggacacacacucaucucaauccagcgaaccccaugaggcaacacugcgcagucucauccucuuucccaaggagagagaucaaugagacagagauaaacaauaaaaagcuuucucauacagaagcccacugagauccaaguucacuguuucuuuugugguccacucaaguacaacagcaucacuuucauuucugcuuugaacugaugcaugcuaauccaggcccaugccacuccaccuccugacugugugccuggucagaggaagacagaaacaucucccaaugacugcgcacccaaggaacacaacaccuaauccgacauuuaagaguggcccggcugggugugguggcucacaccuguaaucucagcacuuugggaggcuguggcagguagaucgcuugagcccaggaguucgagaccagcuuggacaacuuggcaaaacccugucgcuacaaaaaauacaaaaauuagccaggugugguggcacaugucugcagucccagcuacuggggaggcugaagcaggagaauaaauugagccugggagguuguagugagcaugaucacaccagugcacuucagccugagugacagaaggacccugucucaaaaaaaaaaaaaaaagaguggcacauauccugugcauacaaguuuugauuuaguacaguguauaguuuucacaggggaaaagauaaguuuuuaauuuuaagaagagaucacuaucugaaauuuucauuugaaagguuaacauucauuauuuaugaggcucagaauaggccaggugcagugguucacgccuguaaucccagcacuuugggaggccaaggcggguggaucccuugaggucaggaguuccagaccagccuggccaacauggcaaaaccccaucuauaguaaaaauacaaaaauuagccaggugugguggccggcagcuguaaucccagcugcucagggggcugaggcaggaaaauugcuugacacucaggaggcagagguugcagugagcugagaucacgcuacuguacucuagccugggcgagaaagugagacucugucucaaaaagaaaaacaaagccucagaguaaauauucuacucuauaaauucuuuggguuaacguaauuuccggaaaacaaagcucuugauuugggcuccuuugccacuucaccaucaaagaggccuaacauggggaagcuuuugauuuuacuuuuaaaaagaacuacauucagagcaucauuaaugccaugugacuucuacagguagauguuacccuacauuaagaucuuuauucaguugccgggcgugguggcucacaucuguaaucccaacacuuugggaggcugaagcgggcagaucaccugaggucaggaauucgagaccagccuagccaacauggugagacccugucucuacuaaaaauauaaaaauuagccgggcaugguggggggcgccuguaaucccagcuacucgggagacugaggcaagagaauugcuugaacccgggaggcagauguugcaggaaaaaaaaaaagaucuuuauucaguuguagccuuucuccauacaacacucuucuuggaauuaucaagaaaagguuuuuuuuuuauaagcucuuaaagccuaggaaauucuuauuaucugcauucaggcuauuacaaagaccacuguuuggugagcacagcacaaauugcuauaaaacaauuccuggguuaccuauaagccuuaccucuuccugugcuaagauaggugugacuuuaacccaguauuucccguggggauaggaggagacuuacagcauuggguuaagacaaugcuuuauuguacggagaaugccuaacacaccacagcguguuuacugucucugccugcugccaccccaccccaacccagccaaaaugccagcagugcucugcagucauggugacagccaaaaaaaaaaaaaagaaaagccguguccuguuucccugcagaaccacuacagugcccagaaccccuucacacuggcagaagaaugcacaaugcaggugccccucaacacuggcacugcagaugcuuuugaagcuggccaaaguccacuagaccacagaaaaucucuaaauaacacguccaaacuuuccuggagaucacacauuccgccucccugacaaacguacaggguaggcccuugacagaucccgugacuauucccagccuuugugcaaugaugaagaucagucaugcuccccugugcuauagaacccaaaggagaccugagcucucugugaaccuggggcaugggguggaagauuucuuuuucuuucuuuccuuuuuuuuucuggagauggaguuucacucuuuuugcccaggcuguagugcaauggcucgaugucggcucaccacaaccucugucuucuggguucaaacgauucuccugucucagccucccgaguagcugggguuacaggcaugcaccaccaugcccggcuaauuuuguauuuuuaguacagaugggguuucuccauuuuggucaggcuggucuugaacuccugaccucagacgauccacccgccuugcccucccaaggugcugggauuacaggcgugagccaucacgccuggccacgggguggaagauuucuaacuuggagauuucuagcuggcaggcaggccagagcagaauucccaaaaugaagacacaaaucucccccucuccugguggggaagauacaaauuuccccacccccccauaaaggcccagaauguaccaaaaaaauaaauauucuuccuugauuucccaacuuuuuuuaauguagaacaauccccucggcaaugcuaucacaccaaccugcgaaccuccccacuucaaacuaggaaguuguuugacauugaauaaagauucuuacuuuuuccaguuuuauauuuaaaaggauauuuucaaagaugguucaauauuaagaauuauuuuuucucuuaaacacagauaaaaguggaauggucaggaaacuuuauagugcaaaugccuuguaauaauauaauuacgcaagucauccaguuuaucuuucucccucaggggacauuacaccaagccaucugaagaaaaagagccggggagagacuauccaccagugucccuaaauacucccgaaaaggagccucaaggaaagguugcccgaaguugggaguagagagcuacagguauaggcuccaugcuuccuuacauguacaaugaggagacugaccugaucaacucugggauccuguccaggcugacagucugaaguugaaggcaacagaauaacaauuucaaucaaaauccagagaccaagggaagaauuaagaaauaguucguggaggccaggauuugucacagcaaagcuccagacuaaagggguguggagggaugcgccuauagaaagagccaucagggcuggccauggcggcucacgccuguaaucccagcacuuugggaggccaaggcgggcggaucaccugagguugggaguucgagaccagccugaccaacauggugaaaccccgucucuacuaaaaauacaaaaauuagccgggcaugguggcgugguggcacgcgccuauaaucccagcuccucaggaggcugaggcaggagaaucgcuugaaccugggaggcggagguugcagugagcugagauccugccauugcacuccagccugggugaaagagcaaaacuccgucucaaaaaaaaaaaggaagaaagaaggagagagagagagagaaaaccaucagaaugccaggugucaugguuaugccuguagucccagcuacuugggaggcugaggcaggaggaucccuuaaggacaguuuacccagccuggguaacauagugagaacuugccuuaaaacauuuuuuuuuaucuaaaaaaauaaaaagagcuaucagagaacucccacaaguggaccaagguuagggcuuacaugggguccaagcuaugauguucuuucacagcaaugauuccugggugcaauggaaggaggcucuggagagaaggcagccccaggcagaaaggcagggaguagguuuggguugagcccuucuucugagcugaggcuacaaacauuaaaacauacuccuagagaguaccccagcugcaagagucaggauggagauaccccaaaggaaacaaguauuuggggguggggcuugggggcucuggagggcgaagggaaagagaggagcuagggagauuuccagucuucuacaacuuuacaagaguggaccccaggcaaucuuggccuucuucuccuuuuaacuuacauacuaucuauagucucuggcuuccugcaauuucuaucaagaauccuagauauuccugcaauuauguucaaaugacaguucccacacggacgauguggccuuuuuguaacauccuccaaccuuucauuccucugagucaggaaggaaaacaaacucuucagaaguccagaucugaaaaaacccuaguugggcuaacucccaccccuacagcauuccuuuuauucccaggcccuacaaagccugaauuuaguguucuuaaagcugaccccucgaagagcugcagugaguaauuacagcaaacaucaaucacauggaccccgggggaacuaacuccuagggggcccagcccacagagugugcucuugccuacagauuacagaaguacgcuacagagcagaguggucauccucaucuccacuuuguaggggcugcaguuuuauauguucucaucccaccauacacugcaguuuugugguuuacgaauucaauaacaauguuuguugcugguauuuagacagauuuuuuuuuuaguagcuaucaacuuugaaaauugacaucuuuugggaauaucagaccagcccuuaccaaucuccacuaugguaccucaguccuguaagaaacaacauuuuauuuaucaucucucacucaagggccaacucagaagaauucuuuacaccugcuagaaauagugagaaaauaugauagggugaaaauuccauguugugaaaugcccuaugugugguaaccauuaugcagcaggcuaagaagaauuuuugccaucuuuuccauugaaggguuuauggcaaauccaaacucuacuuuauuuaaaggguuuuuuuuuucuuuuuuuuuuuuuuuuuugaaauacaguuucucucguuacccaggcuggagugcaauggcgugaucucagcucacugcaaccucccccuccuggguucaagcaauucuccagccucagccuccggaguaggugggauuacaggugcauaccaccacaccccgcuaauuuuuguauuuuuaguagauaugggguuucaccauguuggccaggcuggucucaaacuccuaaccucaggugauccacccaccuuugccucccaaagugcugggauuacaagcgugagccaccgcgccuggccaagggcaaauauuuuuuuucauuggguacccaguaacccacaaaaacaugauuuuauucuaucaaauaucuucaugguugguuuuucaaaagacagggucucacucgguugcuuaggcuggaguggagacaccccuagcucacugcagccuuagacaccuggguucaagugauccucccaucucagccucccaaguagcugggaccacaggcacgugccaucacgccugauuuuuuuuuuuuuucguagaaacagggucugcuauguugucuaggcuggucucaaauuccuggguucaagugauccuccugccucagccucccaaagugcugggauuauaggcgugagccacugcaccacgcagccugcuuccuauauuguagguacucugcgaacaacuuaggaauuaauaaaauugaaaggccagaaagaaguuaccacaguccauucugcaacaacaaggagacucugucacuaugucacacaggccaagaaugaauguaugucaccaucaucuuaacaccuaccuguaaaacaacaagcauuuuauugcuugaugugugacccugagcaaauagacucuaaaaggucuguguccccguuggucccuuucuaauaguagaaguuguuaaaggagguaagagaaaaugccaacaugcucagaaagacauuauauuuauacaagcuaucaccaccaggaguauuucguuucagcaaaaaggaaguuuacaaugugccuauggcugaauucaauggaauugaauuuuuauacugaacauuaacaaaauguaaacacagaaguaaaggcuaaaugugaaaagguuacuguuaaagggaagcuuaguuaucagcgaaauauauauccagauuaacuagccauuucuauccuugacuuuucucccucuagcaaccuuuuaaaccuuuuaaagguggaauaacccccaccacaagcaucugaaacacagcccacucauauaucacaucuacuuuuggaggagcugcuuugccgagugaacaacagcauuguggguuuagcagaaaagagaaugaacauuucuugucugcacagaaugaccacgcacacagcacucuguacucuuuccaucaacagcagaagaaagcuauuuccuuuggaucagaaagcugccaggacaugcuggcacauucuaucucuucuucacuuugugcuccccugcccuccaguaaagguauagcaaacuacuauucgaccaucuuuuaaaggggguuaggcaacggugcugcaacaugccauauauuugcuuuauuuaccccaaauaaaaacaaguaagguaaacgaaguucaaauauuuacauaccauauauuugcuuuauuuaccccaaauaaaaacaaguaaggugaacgaaguucaaauaugaguucacgcucuucgccuuuuuacuugugguuauuuuccccccuccucaaaugguugcagccucacagcuacugaaaguuauuucaauucuuuuccuguaauuuuaaagucugcaaaagugaccuugaguaacucccaagacuuaccaugaauacaagauacauccgauuaagaggcugguccccaguauagucaccaaguuuucaucucuguacaggucuugaccaaagucaggcacacagauuguaacauuuuucccauguucaucuagaacuugaaaagaaaaaacaaagucaucacagucaaguacaaaggccaguuguaacgcacagaagcacucauuuugggaaaauucagguagcugugguguaccuccuuagaacagugaacacuuaucacuggaaacuucuacucuacaggcuguuuccaugcagacuggauuucugcucuuucaaagaacauucucccacaucaucacauccuuggaacaagacccucagauuccagcucagugccauggggcucaaacagauccagaaccuaaggaaagagucuugcucgaagucaggugcauuuuucaguugacaaggcagccucuaaagagagguagggugcagauaccaagcagugcugaggugaaucaacagccaacaauagcuccuaaacuaguugagaagucauuuugcuguaagugauaugauaaucgugguaucuuucugucuguaacuuggaaacuccugagguguguuuuuuuuuuaaugugaguggcuacaugugauauugugaaauauauauuuggucuucauucgcauuuacuugcaugcaacuccuaaaaucuuugaaaucuccaaaauggugucuuuuuauauguuaaugacugacuaauggcuggcagccccuagguagccucaggaugggggcuggucaccagaaagaccaagguaggauuagagggcugggacuuucagacccacucuccaaacuccaggaaugggaggaaugguaguugaucaccaagggccaaugguuuaaucauuuaaucaaucaugccuguguaaugaagucuccauaaaaggcccaaaaggacaugguucagaaagcuuccugagagcuggaggcuuacaggaaggugaacaccaccucauccacauguuaggaacccagccacaccaacugcauggagacagcucaggacccuuugagaccuugccuuauauauauuuuuaccugccuguuuauucauauucuuuaaaauauccuuuguaauaaaucaguaaagauaaguauuuccugagaucugugagccacucuaucaaauuaauccaucccaaagaagggguaacugugggagcccuaacaguuggucagaaguucuggagggccggacuugugaccagugggaaugguagggcuguuuuguggaauugagccuucgaccugugggaucugaccuuaucuccagguagagcauccgaauuggauuggaggacacccaacugauguccacugccugcuugcugguggggagaaaucuccacuuauuuuagugucacagaaaccuucuguguugacuguuguagugugaaacaguaagaaaaacugaguuauucuaaacacuacguaacaaagauuccuauaauauaaccaucagugguaauuuaccuuuuaccuaacauggagucuuccauuuggaacacccaaccuaggucugacugccaacuuugccaccaaagcaaguaacauaaaguaacacucuagaaaccacuuuacaaacgugcauauuucaagugucugaagugagacuaaaauuaugacuaguauuugcacuugaaacaguaaacguaacuauguaugcugugguuuaaggaaucuuuuauuauuuguauaaauuuaugggguacaaguguaacuuuuuuacauguaguggugaagucuuggcuuuuaguguaucuaucaccaaauaauguguauucuacccauuaaguaauuucucaccauccauccccucccuccuuccuauguuugagucuucacuaucauuccacacucauguccauguguacacauuauuuagcucccacuuaaaagugagaacaugcaguauuugucugugucugcuuguuucacuuaagauaauggcuuccaguuccauccauguugcuacaaaagacaggauuucauucuuuuuuauggcugaauaguauuccauuguguggagauagauauauauauguguguguguguguauauauauguguauauauauauguguguguauauauauguauauauguguguauauguauauauauacguguauauauacguguauauauauacacacguguauauauauauauguauguauguauauauauaaaaaucacauuuucuuuauccaaucaucuguugauggacacuuaaaggugauuccuuaucuuugcuauugugaacagugcugcgauaaacacagaggugcaguuaucuuuuugauauaaugauuuauuuuccuuuuuguagcuacccaguagugggauugcugaaucaaaugguagcucuauuuuuaguucucugagaaaucucccacuguuucccauagaagcuaugcuaauuuacauucccaucaacaguauaaguguuuccguuucuccacauccuuaccaacaucuguuacuuuuugucuuuuuaauaauagccacucugacuggugugaaaugacaucuaguuaugguuuuaauuugcauuucucugaugauuagcaauguugagcauuuuuuucaaaugccuguuggccauuuauaugucuucuuuagaaaaaaaaugaaaugucuauucauguucuuugacuacuuuuuaaugggauuauuugguguuuuuuguuguugaauuguguuccuuguaaauucugcauauugcuccccuauaagacacaguuugcaaauauuuucucugauucugcagguugucucuucacucuguugauuauuucuuuugcuguacagaagcuaauuagauuaacauaguuccauuugucugguuuuguuuuuguugucugugcuuuugaggucuuagucaugaauuauuucccuugagcaauauccagaagaguuuuccuagguuuucuucuagcauuuuuacaguuucaggucuuacauguaagucuuuaauccaccuuuuguugauuuuuguugauuuuuguauguggugagagacagggguucgguagggguucagcauauggaaauccaaauuuuccaggaccacuuauugaaaaggguauccuuuccccaguguguguucuugucaacuuugucaaagaccagauggcuauaaauauguggcuuuacuucuggguucucuaugugguuccauggaucuauucuuauacaaauaucaugcuguuuugcuuacuguagcuuuguagcauaauuugaagaagggacuccuccagcuuugaagugugauuccuccaaguuuuguucuuuuugcuuaggauugcuuuagcuauucuggcucuguuguuucuauacaaauuuuaggauguuuuucugugaaaaaugucauugguauuuugauagggauagcgcuaaaucuguaagacugcuuuaggcaauauggucauuuuaacaauauuuauucuccugauccaugagcaugggaugucuuuccauucgcuugcauccuuuuuauuuuuauuuuuuugagacguggucuugcucuuucacccagucuggaguacaguggccugaucauagcucaccauaaccucaagcuccugggcucaggugauccuccaaccucggacccaugaguagcuagaacuacaggugcaugccaccacacucagcuaauuuguaaauuuuuuguagagaugggauuucccuauguugcucaggccggccucaaauuccuggccucaagccauccucccaccuuggccucccaaagugcugggaucacagggaugugaaacuacacauggccccuccuuuuaaguuuuucaucaauguuuaguaguuuucauuguaaagaucuuucacguccuucguuaaauuuauuccuaguuauuuuauuuuuuguagccauuguaaaugggacuggcuucuugauuugguucucugcuagaugauuacugguguauagaaacacuacugacuuuuuuuuuuugaggcggaguuucacucuguuguccaggcuggggugcaggggugcuguagugcgaucuuggcuagugagccaagaucccucccccucccagguucaagugauucuccugucucagccucccaaguaguugggauuacagaugugcacaccacuaugacuggcuaauuuuuguauuuuuaguagacacgaggucucaccauguuggccaagcuggucucaagcucccgaccucaaaugauccacccacccugcccucccaaagugcugggauuacagaugugagccaaugcacccagccaaaacacuacuaauuuuuguauguugacuuuguauacugcaauauuacugaauucauuacucaaaucuaacaguguuuugguggagccuuuuggguuuucuagauauagaaucacaucaucaacaaacacgacaauuugacuuccucucuuccaauuuggauaccuuuuauuucuuccucuugccugaguguccuggcuaggacuuccaguacuauggugaauaggcauggugaaggcaggcacccuuaucuugguucaguucucaaaaguaaugcuucccauuuuuccccacucaguaugauacuggcugcgggcuuaucauauaugaccuuuauuauuuuaaguuguauuccuucuauuauuuuaaguuauguuccuacuuuauugaggguuuuuuuuuuuaccaugaaaagaugcugaauuuuaacaaaugcuuuuucugcaucuauugaaaugaucauaugguuuuuaucuuuaauucuguuuauguaauauguaauguaugauguaucauauuuauuaauuugcauauguugaaccauucuugcauccaugguauaauacccacuugaucaugguauauuaucuucugauguacuauuacaucguguuugcuaguauuuuguugaagauuuuuccaucuauguucaucagggguauuggucuguaauuuuuuuuuguuguguccuugucugguuuugguuuucagggugauauaucuggccuuguauaaugagucagggagaguucucuccuccuccauuuuuuggcacaauuucaggaggauugguauuaguucucccuuauauguuugguaggauuuggcuaugacuccauucgguccuggcuuuuucuuauuggaagauuuuuuaaaucacugauucaauaucacuacucauuauuggccuguuuaggauuucuauuccuucuugcuuuccagaaauguauccauuuccucuagcuuuucuaguuuguaaguauauggaaguucauaauagucuguaaugaucuuuuguacuuuugugguuauuauugugauuuuuccuuuuucauuucuaauuuuguugauuuggucuucucucuucuugguuaguccaggggcuuaucaauuuuguuuaucuuuucaacaaaccaccuuuuuuuuguuuuguugauccucuguauuguucucauggguuuuuuugggggggaggggggucuuuauuuuauuuaguuccuuauuuuauuuuauuuuuuugagacaaagucccugucuauugcccuggguagagugcaguggugcaauaagagcucacagcucacugcagccucaaccucuggggcuccagugauccucccaccucagccuccagaguagcugggacuacagacaugugccaccaugccuggcuaauuuuuuguauuuuuuuguagggacaggguuucaccauguugcccaggcuggucucaaacuccugggcuccugcaaucugccugccucaaccucccaaagugcuaggauuacaagcaugagccaacucacacagcccugaucuuuguuauuucuuuuguucugcuaacuuuggguuugauuucuucuugauuuucuaguuccaggugcaauguuagguuguuaauuuguaaucuuucugcuuuuuucauauaggcauuuaaugcuauaaacuucccuguguaugcugugguuucaagaaucuuuauucuuaggcuaauuaaaaaaauguagagcacuugaaauuuaaaauaacuuuuuuucuguuuuuuuuuuuuuuuuuuuuuuguagagaugcuauguugccaaggcuggucucagcuccuggcugcaagcaaucuuccugccucagccucccaaggugcuuagauuacaggcaugugccaccacgcucagccuuuuuuuucuguuuuaaagggauaccugccauuuaaaaaauauuguaaauaaaaaucccaguaaguuaaagccagaaauuaauacauaaacagucauaaaagaaagucuuaaagagacuaaauuuauguaaacuuacagagucaagauagaguauuuaaaaaaaaaacuuaaauccagguuaggcaauaguuacuuaagaccuccacuuacauuacuuuccacuauaaacagcaacaaggacaaacccauaaauacuauguguauaugcuaaaacuuucaaaauuaucacugcaccagcuuuccaaauuuaaaagaggaaacaacuucaauucucuuagacacuacauuuauuugacuuauauaagcucaaauauacucaaacauacauuuauauaugcuuauguguauguauguauauauguauguaugucuguguauauuuacauuuauacaucacauaaguaauagagaggauaaguaaguuucugcaaguuacuuaaguagcaggaucagucuauaaaccaggcaguccgacuucaaagcucaugcucuaaucacuauguucuguugucucuguaaauaaaugucauuuaagacgagugguuugaggucacauagccaguaaaucauggaucugugcucagauccugcucccugcuccccacucccccacauucuuuccacucuuuauuccacugcuauagucagaaaagaaaagaaauacaacuaaagagguuauuuaggccuaaaagcaaacuccacagccaaaccuuuccuccugucuguccuacacaccaggaagaaucgaaaaagggaauuuuccuuuacauagcucaaguuaaagacuuuuucaugaaaaagucuagaucaucucucuacugugauuugguacauuucuaacguuuauuuuuauuuuuuaacuuaauuuuuguggauacauaguaggcguacauauuucugugguacaugagauguuuuaauacaggugugaaacauguaacaaucacgucaucuaaaaugggguacccauccccucaugcacugaucuuuuguguuauacaagcaauccaauuauacucuuuuaguuauuuuuaaauguacaauuaaauuugacuauagucacccuguugugcuaucaaauacuaggucuuauucauucuuccuauuuauuuuguacccauuaaucauccuaaccuccucccaaacccuucccagccucugguaaccaucuuucugcucucuaucuccaaggccucuccaauauuuaaacaauagcucauuccuccaugaaugaaaauauucacaccgcaaacacaagcccacuaacaggcuggcuuaccuacuucugcagguuugcuggacagagcugagaaggugagguaggugacauagcagcuuaugaccccugauuguaagagccccgaguguggcuguccugaaaagugacaagagacagacaacagguuuuaauuugaagaaaaagaaagcacaugccuaaaaaaccugauaguccccaugacaguccucaaacuugagcauccaccuuuaaaggaaagaaaagagaaaaaaauguaguauguuucucagauaaaacuaaaaagauauuaagggggagagaguuacacgcugaacugaacauugcuacuucaaagacaucagguucugccaaguuaucuaccaauacuuuaucaagccuauggcuacacuuaaaacacacuaacuagucucccugagguuuguaacauuaguucuuaaaucacaagaucagaaaaaaaauuaccauaguuguugauaaaaccacauagcuuaauuggggaggggaguaagugguaaaccagauuucauaggggauguauucuggauucuacaaggucaucacauacuacagucuaugacagggcaaaaagcucuuaccugccaaugaucaaaaagcuuuuggggacagaauacaagaacugcucuuggcuaaagaggaaggcuauggggcucagcauucacugggagaauggcuuuaagguuauuuauuuauuuauucauuuauuuuuaacuuuuauuuuagguuuagggguguaugugcagguuuguuguaaggggaaaauugccacagggguuugucauauagauuauuucgucacccagguauuaagccuaguacccauuaguuaucuuuccugauccucuccuuccucccaccuccacccucugauaggccccaguguguguuguuccccucuauguguccacauguucucaucauuuagcucccacuuuuaagcaagaacaugugguauuugguuuucuguuccuguguuaguuugcuaaggauaauguccuccagccccauccacguuccugcaaaggacaugaucucuuuccuuuuuauggcuacaccguauuccauagauuccauaguguauauguaccacauuuucuuuauucaaucuaccauugacgggcaugucggugauuccauaucuuugcuauugugaaugccugugucuuuaugugagaaccauuuauauucuuuuggguauauacccaguaaugagauugcuggaccuaaugauaguuuuguuuuuaggucuuugaggaauugccacccugcuuuccacuaugguugaacuaauuuacauucccaccaacaguguauaaguguucauuuuucucugaaacuucacaagccaucuguuauuuuuugaaaguuauaauauuucaaggaaacuaaggguucagauccuucagaguaaccaggaugugauaagggaucucucuuucuuuccugcgaaauuuucgaccacuugccgacauaaaaggaugcaguuuuuacucagucuucccuuuggucaaauuuguuuccaaaauuaucauuauuaaauuguaauuaccaauaaagacauaaaauagacccuguuauaauguugcucuuuggcaagggaauaagauuuuccuuagcaccuaaugguauuaaaccaaguauuucaaaacauuaucccuauuucaaaagguaggacuuaacccaaagauuuuaaucggaauaucaaguuguucuaggaacucuuaacugaucaauuaaagggauuaggagaauaauacucucaauuucaauaauggucuuaaaauuuuuaauagaagaaaacaaauuauuugugacuaguugccuuuuuuuuuuucgacacagagucucacugucacccaggcuggagugcaguggugggaucuuggcucacugcaagccccgccucccggguucaagcaauucuccugccucucagccucccggguagcugggaauacaggcgugucccaccauggcuggcuaauuuucuggguauuuuuuuguagagacgggguuucccgaaguuggccaggcuagucuugaacuccugaccucagacgaucugccugccucagccucccaaagugcugggauuacaggcaugaacaacugcgcccgaccacuaguugccuuuuuaaaccacuauuuuagaaaugauucaagggggcuguacauuuauugccuguauuuuccuaccuagaaccugaaugucaugugcauuuucaucaccuauaggguccgacacccacaaaaaaaaucagaccagggacaucucacuguaagcccaaagacacuauacccuggcuuaagaaaccaagaguaguuuauaaauggcaauucacauuuauacuuccuaaagcacuuucagaucccacugucucuuccuuccggcuuugaaacaacaaugagcaaggucaggcucacauguuuccacugaguuuacugaggaagaaccugggucuaaggaagguuagcacaugggccagcugcuggcugagcugggaugggauguccugcuuccugacucccagaccacacuguccacagccuugagugaaagaugaccccagaaccaaccccuucugcggcccuuucauucaacuuuuacacagagauuguaggcaagcucauaaacaccugaucuugauauacacggaaggcauuucccauuuaaaggcucuuugugguacauuauuuagcaaaggcaguaucuuccuauucauugacuucguuacguucaggucuuucucgacaugagaaaugcuuggcuaucacagcucgagcaugagauaugaagagacuggagccccaccuugccuacugcugacacauccacaguaaguuaaggaauacacuaguuccaaacaaacaaaacaaaacaaaaaaagccauuggguuugcucaaagacacuuaggaaaauauaaguaacgaagaauggaaaaaaacaugcuuacgauuuuggacccagggugagauggcuaccaaugauauaagcaggcacaggccuccauuuacucccagcagaauuuuguuuuccaugcagcugucuuucuguguauaaaacacugccaucaaaaccaagccuccaguggcaauggaauacaugaugagcgucaccagggccagggaggcguaccacagcuuguuacuggcugugccugcuguccuguuucuccgggaaguggguaagagggagaggagagaagacaagucaacgaagcccaccauucugcgguaacagucaccaucccucaggcaguaacuaaugcuacaggccacaggcacugguacccagcugcucagaagacacauuauuuuagcagugauuaugcucaucaaagcuagaagguucugguaaauauggaaacuucuugacucaagcugagaauuuucucucaacaaugagagaauuccacuuucugcgacaaauguauucauucauuaaaaugaauaaugucaacccaaaugagagacugaggcaacagucucaaucagccgagguguacugagccagaggucugagggugcaccuaaaagcacacaagucacagaaucuucuguggcuggugcucccaaagagguugcagaaggcucaguauuuacccauuucuuuaaaggggagaaggcacgcaggaaaagggggcagguggugaggcaaacgugacauuccccugagauuuuaacuagugcccaguaaacccugcuauacaagagauaugaucaacauucaaaaagggaguaaaggaagaguuaauuauguagucucaggguaagcagagaaaugacugcuguccugucuuuguucugcaccugggaagauaagcuuguaauggacauugucagugugaaauguaacagacugcaauuccauggacagggagcuagacuuaggucgcagaccuaaaguuacagcugacauguccuuuuuuaugggaagauacacaucuugaaagguuuagggacaagcagagaauuuacuuaugagcaauuugagggcagccauccggguugcauggggccuuuugccuucuguagagaucuagcuaauguguaguccuuugacacaagguugggaagucacagcuaucuaugggcagguggggggagacagcagugucacaugacugugucuccaggcuuaacucuccauuugguguaaugaguuugagcaguccugagacucuuuauuuccuuuagcuaccuacagacuuuauucuagcuucuccauucugacuaugaaccaccgugggucaguuuuuggcaggaugaaaaaaguggcucuucacugggcuuccccaaguuuucuccauaaacacagagccccgaagcgccauagucucuacuccaaagugcugccaggagagguggcucacaccuguaaucccagcacuuugagaggccgaggcaggugaaucacuugaagcuaggagcucaagaccagccugggcaacaaggcaaaaccuugucucuacaaaaauuagcagcauguuguggugcaaacuuguagucccagcugcuugggagacugagguaggaggaucaccugagcucggguggaugaaggcugcuaugagccaugacuguacuacugcacuccaguuugggcaagaguaagacccugucuaaauuuuuuauuuuauuuuuuuuugagacagagucuugcucugucgcccaggcuggagugcuguggugugaucuuggcucauugcaacccccgccucccagguucaaguaauucucugccucagccuccuuaguagcugggauuacagguauccaccaccaugccgggcuaauuuuguauuuuuaguaaagacgggguuucaccaucuuggccaggcuggucuugaacuccugaccucgugauccacccaccucugccucccaaagugcuaggauuacaggcaugagccacugugccuggcccuaaauguuugauaauaauaauaaauaaacuuuuaaaaacagaaacaaaguguugccagcagcucugaugccaucuucuuagggaggaaagagaauuaccuuuacuaagagccauacuggcugaccuuagcucuuuauucccuguacugaagagaaggaccuguaacugugcugcuucuuuaucuaaaauaguaucagggaauaguaaaggaaaauuugacauuaaaaaaaguuaaauagauaggaauaaauucuggugaucaacuguaugguagggugaugauggcuagcaguaagguauuguauauuacaaaacagcuagaggagaggcuuuugaagauucucaacacaaagaaaugauacagccuggccaacagagcaagaccccaucuacaaaaaccaaaaaccaaaccaaaacaaaaaacaaacaaaaaaauuagcuggacaugcuaauuagccagcuucuugggaggcagaggcaggaggauuucuugagccuaggaguucaaggcugcagugagcuaugacugcgccacggcacuccagccugggugacagagugagacccugucucuuuaaaaaaaaagacaaaaaaagaaaggaaagaaagaaaaagaugauaaauccaugagguaaugaauagccaacuaccuugauuugauuacuauauaacauauauguaucaaaacgucaaaaugaacccgauaaauauguacaauuacaauaugucaauuaaaaaauaaauuagggcaugguggcucaugccuguaaucccagcacuuugggaggccaaggcggacagaucacgaggucaggaauucgagaccagccugaccaacauggcgaaaccccaucucuaccaaaaauacaaaaauuauccgggcgugguggugcaugccuguaaucccagcuacuugaguggcugaaucgcuuggacaccagaggcagaggcugcggugagcccagaucaugccacugcacucuagccugggcaacagagcaagacccugucucacacaaaaagggaaauuguucagaacaaaaaaaaguaucuauaaaugcuaaaugaagaggacagaacagggagaaugaauugaaugaaucauugucaucugccuuaugauuaaauugcucuuuguaaccacauucucccaaaccucacagaaaaagcaacuugcuuuaugcccucacaaaacuggaaaguguucaagcaacccagcuaaaauguuuuaaugaugaaaaaguuccugcaaccagaaacaaagaaaauagggaggaaaggccaaaaugauaaugaccgucauauuccugaaacugugccagacacuccaaugaccuuggaauuauucuaacauaaaaggcauacaaaggaaaugagagaaaaaugggauuuuaagaaggaaaaaaauaucuaagagcaaauaauaauggaugauggggagacagcaugaauuauacagaaaaagguaaacacugcugacugguuugugcgugggagacgaccaacgcuucuauucacuagucuuuuugguuauguuauuagaauaugaaggacuuucuuucaguuaauuuauguuuacaguccaucccaaaguuaaaucuucaacccuaaccuuuccccugaaugucacuuauauuauccccuuguucauuuaacaauuggagacccacuugaaggucuaacugguaucucaaacuuggcacauccaggcuaaggcuaacuuccugauauugacacccccauuccuccaucccccaaaccugcuauugugcaauuaucccaaccucagaaaacagcaacuccaacuucccauuguuaggggaagagggaaagaaagaaagaggaaaggaaagaaaggaaagcaaagaaagaggaaaggaaaaggaaaaggaaaggaagaggaaaggcaggaaggaaagaaggaaggaaggaaggaaggaaggaaggaaggaaggaaggaaggaaggaaggaagaaaaugaaaugaaaugaaaugaaaagaaaagaagccgggugcaguggcucacgccuguaaucccagcacuuugggaggccgaggugggcggaucaccaggucaggagaucgagaccauccuggcuaacacggugaaaccccgucucuacuaaaaaauacaaaaaauuagccgggcaugguggcaggcgacuguagucccagcuacuugagaggcugaggcaggaaaauggcacgaacccgggaggcggagcuugcagugagccgagauugugccacugcacuccagccugggcgacagaacgagacucugucucaaaagaaaagaaaagaaaagaaaagaacaaaagaacuguggucacucuggaagcuucuugcugcucuccccucccccacccaccuccacccagagcuggcuuuggaacauaggaggauccagcuccuugcuaccacuuaguuccagacuacuccucccucaccuggauugacucccccugaccuccuuacuugcaccccugacaccuuuucaccuuucugcacuuaaaacagauuauauuccucccuuuuuaaggcccucuggugcucucccaucccacuaaaaauccaaaaaaagucuuuacacucgacaccuaaagcccuuuguuucaauucuaauagagaauugacacuguaaaccacaaaauuugagcuagaaaggaaaaaaaaagaacacaccaguuaguccaaacacauuauuuaagugugaaaauggaggucagaggggccgacugaugagcucuacagugagaacaagcauuaaaaggggcacugaagccgaacacaaugucaucccaguacuuugggaggccaaggcagaaggaucucuuuaacccaggaauucaagaucagccugggcgacguggcgaaaucccaucucuaccaagcaaacaaaaaaagaaauuagccaaguguggugccacaugccuguagucccagcuucucagggggcugaggugggagaaucacugaagccugggaaaucgaagcugcagugagccaugaucacacaacugcacuccggccugaaugacaaagugggaucccaucucaaaaauaauaauaauaauaauaauaauaauaauaauaaaagaaaaagaaaacaaaaggguacugaaaucugcaucuccugguugccaggcccaugaccuuucuauccuacuguuuuuaggaucaucuccuucucaagauauuuacaaagagauaaaugaaaaagggaagaaaagguacuuuaguuguucuauuaagagcaaugagcacauuuucuagauucuuauaagcaagagucuguuaaaaaaacacagcaaggccaggugcgguggcucgagccuguaaucccagcacuuugggaggccgaggugggcggaucacgaggucaggagaucgagacccguacgagcaggggauugaguguggcuaauucacaccacugguugacucagagcccaagcaagggaguaggggcagggggucaaaaagugagaagugaaugaaggagaggaguaaaugaagagguacaaaaaagcagguauaaagggaaacaaaacugcaaaucccuagcaaugcaguugaguacagccuuggucaaaacugggcaguuucugugagucaaugggaagcuuuccauaaaggcacacaccaguucuuguuccacuuaugugcaaacuccacgagcaggaggagcuggaugccaaugaagaggaagccuccgacggcucccacauagcgccaggcugcaaaagaccaugaagaacacaaugaggcaaccuuucguuguauuuugcucaaaagagaauaaccacagcuaauuuuuacuagaugaucaguguaccuaacauauuugucacacaaccauauaagauauguauuacuauuauaaaugucacucacuuuacagaagagaaaaauugagaaucuauguagguugacaacaucucagucaauaaaugguauaguugggaucugaacacaggcagucugacccugaaauauccaagcuuauccuccacacuacaucugccagguacccuaauagaugcccuaauucauaaaauccauaaugacccacaacuuaaaagcaaacacauauugccaggaaaaucaaagguucaaauuuuauuggguaaaaagucaacaaugaccaguaaagaaacaagguucagacaggggacaaggacucgguucgacuucuggcucugccacaaagacgcuauaaccuugaauaagucacaucacauggguuccaauuugucuauaaaaaucacugagcuggggcugggcacaguggcucaugccugcaauccuagcacuuugggaggcugaggcagggggaucacuugaggucaggagucggaaaccagccuggccuacauggugaaacccugacucuacuuaaaaaaaaacuccaggcauaguggcgggugccuguaaucccaucuacucaggaggcugaggcaggagaaucacuugaaccugugagguggaggucacagugagcugagauugcaccacugcacuccagccugggugacagagcgagacuuggucucaaaaaaaaaaaaaaaaaaaaaaggacugagcuuggccggccgcaguggcucacaccuguaaaucccagcacuuugggaggccaagagggggcggaucacaaggucaggaguuugagaccagacuggccaauauggugaaaccccgucucuacuaaaaauacaaaaauuagccaggcgugguggugcgugccuauagucccagcuacucgggaggcugaggcagaagaauugcuugaacccgugaggcagaggcugcagugaggcgagaucgugccacugcacucuaaccugggcaacagagcgagacucugacucugucucgaaaaacaaaaaaaagacugagcuggaccagaggguuucuaggucucuucucccuccaaauauacauucuaauacauaaaaggaucucuguagagaauuuuaaaacuuuuaacaguauuuuagguaacagcaagacuuagggaguacaugaaaaacaaguaugaccuuaaacaacuagcuaggcccugauacauaacuauaugaaggauuauggcuguuccuuauaaacugacacaaucuaaauguuuaguuuaguuuuguuuuugagacaaagucucacucugucgcccaggcuggaguacaguggugcaaucucggcucacugcaaccucugccucccagguucaagcaauucucaugucucagccuccugaguagcugggauuacaggcacacaccaccaugccuggcuaauuuuuauauuuuuuaguagagaugagguuucgccauguuggccaggcuggucucagacgaacuccuggccucaagugauccacccaccucagccucccaaagugcuaggauuacaggugugagcuaccacgccuggccuaaauguuuuuaauaccuuacuuaggaaagugaauccauuuggguugaacaaaaugcucugaaccacugaaauucagguuuuucccucagcucauaugaaaaagggcgcccuguuucagcuaugauuaaaggcuucauauuaaugaauuaaagcagguucuaacaauaaagaauauaauucaaugcuacagagcuucacauacgguaaguuuaauaacagacugaaagaugcuuuuccugucccacuaucgcugcagcagacauuuagcugcugacagcccugcgcucccuguugcuggguuuucugugcagugcuuggaaagaacaaggucucccaggccagcagaguaucagaguccucuuacacccuaccuggaagugggaugcgguggugagaagaggggagguagauaggcaaugauggaaaaaguaugggcagguaagucaggaauuucuuuugaagccaaaagaaaaucaguaauucuaacuaucagagguacuuggacugcgcuucugagcaauuugacaaaauggguaaaaacaaaauaaacagauacccaaaauaccccauuaguaccguucagaaagguguccugaucuggaaugaagaaagcuccugagcacauggcccccaacagcagaaguuuaaagaaccaaaagcuagaaguggggggaaaaaaaagaggaaauguauuuaaaugacauucaagaaggacaaaggaccucguagaagguacagcaugucaauccaugauucugccauuggccaauguucucuccuaaucaaggggaaguaacuaggugacuugaagaaugcuuuuucccauaauuaggcagacucagugcagccuccaguugugcaaaacaccauuucauugcagggguggaaaugaccugggggaaggucuuggaacaagaaauaaacucuuugucuugaguaaauuucgcaucaugguaccagguguuacaaauaagauucuaccuuugaggcaaccauguggguaaguaucaauuccaccuuccccuaaaucaacaauuucaacuagaagaagggcagucacagugucuggugggcagaugggauccuggacuacuguccugaacauaagaaaggagaaagcaauccccaagaagacuaaaauacuuacccauugugaauaugagcucuacaacuuuugcuguuguugauuuucaaggucaguagacagaagauaaagaagaaacaagccauuccaaaacagacucuauacacggcagaauaucccaccagcuucucacaggugucaccagcuuuaaugccuuuacacauaucuucaaaaaaaggaaucugaggagaaaguuuagaaaagucaucuguuacaacugagugagagguggacugucacggaguguucaugcagccaaccacaacauccacuguggaaauggaucgugugcauaaagaaacagacugaggaucuaucuucuaaagagauauuuuucuaauuuucucugaaucuuuuuuaaagauacagugaucauaaaguaacacucagccuuuacuugccccaaaugacuucugaaauccaacaucagauuuuacaaaaauuaccuuuuuuuuaaccgcccccacccccacccccaccccacccccgaccccaagacaaggucucucuggcucuguugcccggccuagaguuuaguggcacaaucacaacucacugcagccucgaucuuccaggcucagguaaucuuccugccucagccucccaauuagcugggacuacaggcacgcaccaccaugcccagcuaauuuuuguauuuuuuuuuuuuuuuuuuuuuuuguagagaugggguuuugucauguugcccagacuggucuugaacuccugagcucaagcaauccaccugucuucgcaucccaaagugcugggaucaucauagguaugaaccacugcaccuggccuaaaaucccauuucaauacauggauauauuuuuguugauauguauacauauauacaaauaaaaaaucagagacuucuuuuacuauccacccaaaaugucacuccucucccucagaagaguaaacaauugguggguagaguauuuguauuaauucacauacauaaauguguguguauacauauauacaacacacucacauauacauauacauacacaacacacauacauacacucauaucauacuaugcauauaauaaauauauuaaaacagcuuuuuaaaauaaaagauuguauguaauguucugcaauauuuuuucccaauuaacaauaagcugggccagacacgguggcucaugccuguaaucccagcacuuugggaggccgagguggguggaucaccugaggucgggaguuugagaccagccuggccaacaugugaaacccugucucuacuaaaaauacaauaaugagcccggugugguggcucgugccuguaaucccagcuacuagggaggcugaggcaggagaacugcuugaaccugggaggcagagguugcagcgagccgagaucgugacacugcacucuagccugggcaacagagugagacucugucccaaaaaaagaaaacaaaaauaaacaauaagccaugaagagucuuucucuauuaauacgcaaaaucccaucacauucuuuuucaucacuaucuuauacuguaaaaaggcuugaucaaaaucaauaaccauucucacacugaucuuaauuuuuuguuggggaggguuuuuaaauuuuauuuuuuguacuuguuuuuuauuaucacaaacacuaauucaauaaauacugcuguucaugccucacugcaccugugccauuauuuauguaggacagacaccugagcuagaaauggaauuaguaggucaaguagucagguugaaugucccuuauccaaaaugcuugggaccagaagucuuucagaauuuggaauauuuacacuauauuacuggcuaagguucccuaauccaaaaaaauccagaaugcuucagugagcauugccuuugaguaucauguuggcacuuuaaaaguuucaaauuuuagaguauuucacauuucagauguuuggauuaggaauauucaaccaguaucuacauuuuuaaacuucaagaugaguuaaaucauacuuucaaaggcuguaccaauuuacauccuaccaguaauaucugagauugcacauuucccaacuuggacaucuaauuuaaaggcaaaaacccaauauccuguuuuaagguacaucuuccuuauuacuagugagauucagcaucuuuucucaaguuuauggccaucuguuuuuuuucucugaauuggcuguuaauuggguauuuucuugauccacuggagcucuuuauuagugggucuuaaucuucugauaaauguugacaauagcuuauucuagccaaauuagaagacuuccacaugaaauaaucaguuucauuaucagaauaauuaaaaucuuacacaaugagaacaagcagcacauuccuaguaaugucauaaaauaaggauuuggucagucauaaaaacuugcuucuuaucaacaucaaaguugaacacucuucugaacagaaaauaaaucacauuauaacuauuauucauaagaaaaauaaaguaucacagagaaaaaauagcacaaaacugaagguaaaaggaaagugugauaaagaagauaauuuacaguuucuucuccagaaaaagauacugaagaaacaauaauaucuguggcuaucacgauuuccauaaacaaaugucaacccaaaugagagacugaggcaagagucucaauggggaauaauuaagccagagcuugaggggcugcugagaaacacacaaaucacagaauccucuguggcuggcgcucccaaagagguugcucgguauuuacccauuucuuuaaaggggagaaggcaugcaggaaaagggggcagguggugaggcaaaugcaacauucuccugagauuuuaacuagugcccaguaaacuccgcuauaaaagagauaugauaaacauucaaaaagggaguaaaggaagaguuaauuauguagucucaggguaggcagagaaaugacugcuguccugucuuuguucugcaccugggaagauaagcuuguaaugggcauugucagugugaaauguaacagacugcaauuccguggacagggagcuagacuuagauugcagaccuaaaguuacagcugacauguccuuuuuuaugggaagauacacaucuugaaagguuuagggaccagcagagaauuuacuuaugagcaauuugagggcagucauccgggaugcacgaggccuucugccuucuccagggguguggcuaaugcauagcgcuuugacacaagguugggaagucgcagcuaucuacugggcaggggggcaaggugcgaggggacagcagcagugucacgugacugucucuccagucuuaaguuuccauuuggcauaaagaguuugggcaguccugagaggguuuauuuuccuuuacacaaacaaacaaagaguuccauuuucuccccacuccuuuuugagacagggucucacucuguacccaggcuggagugcaguggcgcaaucuuggcucacugcaaccgucgccuccagggcucaagccauccuccuaccucagcuuccugaguagcuaggacuacaggcaugcaccaccaagcucagcuaauuuuguguguguguguguguguguguguguguacaguugguguuucaccauguugaccaaacuggucucgaacuccuagacucaagcaauccaccugccucagccucccaaagugcugggauuacaggugucagccacuguaccuggccagcuccauuuucaugaagacaugugaaagacuucaugaggaaauagccaacauuuuguuuucagcaaauuccuaaaacuguacauuuuuuaugacuuuuuuuuuacaccauuuugucacaacagagacaagauguuuugcuugauaaagacugcauccaaccagauaaguagauaaacaagcacagucuucaacuaucaguccucacuggaggacucuguggccauaaaaaggguagguacgguucuaacucgugacaagcaccuggcaucugccccgaaggcucugcccacaucaaagacuguuucuugcacaaccaaccagauuaaccagcccagaccaggaaauucuuuuuuucuuuauugcucucccuggacuacuucauuaacccuuuuccuauucccuuucucuuaauguuaaauguuauuuuguuuguugcacaauguuuaaucaguaacauuuauauauugacagaguauacgauuguguacgguuugcaauacugacuggcuggugcagaggcuggaaccugugugccugcagaucuaaugaguggaugagaaguacuaagaagaauuggcucccugggaacuccacauagcugguggcuuuuguaacugaaauagcaucaguuaaguccaacauuauggaaagacacaaauguucguggaccugguuaccucugaccuuggcgucacucacaaaaaccaagauaugccacccuaaaacauucuucuuugcguauuucaagcucguuauucugagaagcugaagacacaggaguagcucugcaaagcugcuguuuuauacaaaaaauuuacaucuguagaggaaaucuacauuaguaaaguguaucagacguuuauucaccauacauuucuuccccucacucucccauuacguguugccagcaacucccagaggccccaagccccuauuccucucuguagcucaacaugccauaagcuucuaucaucugaccgcccccccccccuccgcuuuuuuuuaauugagaccucuguugcccaggcuggagugcaguggcgcaaucucgccucacugcaaccucugccucccagguucaagugauucuccugccucagccuccagaguagcugggauuacaggcgccugccaccacgccuggcuaauuuuuguauuuuuaguagagaugggguuucaccauguuggccaggcuggucuugaacuccuggccucaaaugauccgcccacuucagccucccaaaguucugggauuacaggcgugaaccaccaugcccagccuaucugacccuuuuuaaaauugcuuuuucuccuguaauuggucuuaugucaauuuaauuugcuuccagagaaagaaccuagaagaguggaaggaagccauuuuucccuucucuacaaaggcaaggucuugcugggaagggccaggugcaugccagacuuagcagucaggcccccauccuguaagcaaggggaaaagcacuacugaagcuagaacaccuuuggcuacaaaguggaagacguggugaaaggguacagacuugaggcaaggggacaaguuugaaggccacugggaacaggugaagaagguaaccccaggcagagaaaccagagauucugcagguagagcucacaauuggcaggagagcacagaugacaagaaugaagcacaagaaugagacaaagcuguuuuguuuucuucuuuuuuuauggcauugccguuugggguggagggaggguggagggcagaggacagacagcagaagugaagaacaaagcaggaguuugcucuuuaacaccuuagggcaucaccaagggguaucccagcgagaacagucuggucuggaaauugcuuuagaacagcaauuggggcuggauacaggaagugucaggccucugagccuaagccaagccaucucauccccugugacuugcacguauccccugugacuugcacguauacgcccagauggccugaaguaacugaagaaucacaaaagaagugaaaaggcccugcucugccuuaacugaugacauuccaccauugugauuuguuccugccccaccuuaacugagugauuaacccugugaauuuccuucuccuggcucagaagcucccccacugagcaccuugugacccccgccccugcccaccagagaacaacccccuuugacuguaauuuuccauuaccuuccuaaauccuauaaaacggccccaccccuaucucccuucgcugacucucuuuucggacucagcccgccugcacccaggugaaauaaacagccauguugcucacacaaagccuguuugguggucucuucacaccgacgcgcaugaaaggaagcacccgcaggcggguaaugagaagucagucacacaggugcuuucuggaggaaccucaauuuuuagcuguguuuaaacaugagugaugaaacagcaugguuaaaauuuucaggugcugaaauaugguaggggacacacacaaaaaugaauguuucagagagucuaacccaaaacaaaaguuacaccuguaugaguagugccaguaacgaggagguaauauugcuuugaaucucuaaaagcuacauucauggagaagccauaccacuucauucauuaggcuguuucauuuacacaggauuuauugcucuaaaacauucccuaaauuauuuucuuccccaccuucucucuucuacuccaucagcaacucuaauuccugaaccacaucuuccccauaacacaugcacauuagcaccucuuucaucuauaccagcccaucuuucaccuuuagaccuucucugccucccuaccucuuuuuucuuccuccaaaauccauuucaaggagaaugcuaacagcagcaggcugagccaccauccccaacaaauccccucccuuguuugcuuacuccagaaucuggaaugcggccagggcccuuuaaggcucaucacagggugaguacauugacacuguauauucaucaaaaacagguaaacaaccccccugcuccaaauccuaaucaagaccuccuuuauacucugugggugacuuagcacauuuaguuuucaguaugugguaaguauuuuugggcaaagaaccuccaaggugaacaagcuagcaggauucuggcaaggggaauuugcuccgauuaaauauuugcuguuccaaaguccaccccauuuuuggaaaaagaaaaaauacaucacauacaaauuccacaccacagggugaaaggaaugugccugcuaaggguguuaccucuuaagucuggcucugggcacccaaggacagggcacuuaagccaggcucacacacuguauguuguuucuuuuuuuugaugcagucuugcucuguugcccaggcuggagugcaguggcgcaaucucgguucacugcaaccucugccucccagguucaagcgauucuccugucucagccucccaaguagcugggauuacaggcauacaccacuaugcccagcuaauuuuuguauuuuuaguagaugggguuuugucauguuggccaggcugguuucaaacuccuaaccucaggugaucugccugccucggccucccaaagugcagggauuacaugcgugagccaccgcaugcaggcuguauguuguuucuauacagaccccugagaacaaggcguuucccuccaacccucaaagcaaccaaacucaaagccacaaacuaucaaguaagaauaaacagcucauaagacuuccauuccuaacuccacugcuaacuugagcuagcuacacacauacacacccugagccucaguugugccaucuguaaaaugaaacaauaccgacacccauuucauggaguugccugagaauuacaucagauaacaccugugaagugcuuaccacgguuccuaacccauaguagucauuaaguuaacuucuuuaauucuaaagcacuauuauguuauauuucaugcgcguccgugugaagggaccaccaaacaggcuugugugagcaauaaaagcuuuuaaucaccugggugcaggcgggcugaguccgaaaagagagucagcaaagggagauaaggguggggccguuuuauaagauuugggcagguaaaggaaaauuacagucaaaggggguucguucucuggugggcaggaaugggagucgcaaggugcucagugggggagcuuuuugaccccggaugagucaggaaaaggacuuucacaagguaaugucaucacuuaaggcaaggaccggccauuuacacuucuuuugugguggaaugucaucaguuaaggcggggcagggcacauucacuucuuuugugauucuucaguuacuucaggccaucugggcauauaccugcaagucacaggggaugcgauagcuuggcuugggcucagaggccugacauuauauaaaaauaauuucggggaagagacucagguacauuacaugauccacaaacuaaugcauuccgauuuaaacauggugggaaacugaacaucuuagaauuaguagaugcucuauucacuuuaccaaaggaucuacuaccuuuggauugaaagauuaacuuucuuguuuugaaaaaaaaaaaaaaaaaaaaaaaaaaaaagacagaguuucacucuugucgcccaggcuggaguacaguggugcgauuucagcucacugcaaccucugccucccagguucaagugauucuccugccucagccucccgaguagcugggauuacaggugccugccaccaugccuggcuaacuuuuuguauuuuuaguagauaugggguuucacuauguuggccaggcuggucucgaacuccugaccucaggugauccacccgccucggcccccuaaaguguugggauuacaggcgugagccaccgcgcccgaccugucaguaaggugaaucuuuccuugguacauuuauauuagaacugagguccaaaaaauagcacucacuacuuguccuucagagaccuagccaccauccagaagaaagcauucugaacucacaaauuaggaaaaacauuuccaaaacaugaaaacaaguaauaaacucaacaagaugcaagggagaagaaaauucacguaauuuuguuuacacaggagagaugcuagcuaugucccuaaaacaacuucaaucccaggcaaauaaacaacaaaaaagcuacaggaagaccuacaggucuaauuggccaggggcccagaugcuacaaacauagaaaacauguauaaguuuugggaguggcuucuuaagaaauggagaggaaguaggugaaaguuguaguuguguaaucguguuacuugagauuagaaaaugcaauauuaggccaggcgcgguggcucacguauguaaucccagcauuuggggaggccaaggcgggcggacugccugaggucaggaguucgagaccagccuggcuaacauggugaaacuccaucucuaccaaaaauaccuaaaaauacaaaaauuagccaggcgugguggcacacgucuguagucccaaguacucaggaggcugaggcaggagaauagcuugaacccaggaagaagagguugcagugagcugagaucacgccacugcacuccagcuugggugacaaagcaaaacuccaucucaaaaaaaagaaaaaagaaaaugcaauauuagcaaagcuaauuauucuuacauuucauuauauuaauaucaaauuucaaagaaagcuuugggcagcuccacaugagggauaaauuagguucacaaaaacuagaagaacuagauuugcaaguucuguuuaauaucccucacuugaaaaugcauuucagaaccuagaaugucucccagucugccuuucccuuuucugauauuccacucaucuucaaacuuuccaggauaguuuguuuuucuccaugaaguacuuccaggguccaccacacugaugacuuccuguuauuggucaguggacaacagccaugaaaugggaaacacuaaaaucagcuucccucuuuccuuacacagccucuuggcaaccaaagcucauuucucaguaagugauugccuuugaggcccuuugggggaucuggggcuauuuaauaaacaauaacaacaaccaguacuggcuucucuuuucuuuggguuaucugagcauuuuuaauagaaaaaucuacauuguaucauuauuaaaagccaaaagaugaaugaaaauuaaucucaaaaagcaugcaaagacugagaaugcgaguucacagcuccuccuccaccaugaauauuuugucagaaucaaacagucacagauaggauuaagcagccagaaagcaacucuaagcaaaccguuauacaauaagcuccaaaggagacaacucccagaagacugacuaauuaauuacuaugggaagaagggcuccuccacagaugcagaacaggauucaacucauuucaaucuccauugagagaauuagguaaaacugaaggcagaaggcugggugcgguggcucacgcccauaauccuagcacuuugggaggccgaggcagguggaucaugaggucaggaguucgagaccagccuggccaagauggugaaaccccgucucugcuaaaaaauacaaaaauuagccaggugcauggcgggcaccuguaaucccagcuacucgggaggcugagacaggagaaucgcuugaacccgggaggcgggguuugcagugcgcugagaucccaccacugcacucuagccugggcgacagagcaagacuccgucucaaaaaaaaaaaaaaaaaaaaaaaucuaacugcaaaggauuauucucaauuuuauuugcacuuauauaagcaaaacaauuauauauuuuacugccaaaauguguaaauuacaauaaaaauacaaauaacccaguguccuugcccaucaaugccucaauucuaacuugauugcuucccuagaggugccacuguccccaggugugaguggaucuuucuagacccuuugcugugccauuauucuacauucauuaugucuuggagguugcuguauguuuaacagauaaaucuauuugcaucuucuuacauacuacauagaauucuaggcugggcccaguggcccacaccuguaaucugagcacuuugagaggccaaggcaggaggaucacuugagccccggaguucaagaccagccugggcagcacagugagagaccccgucucuacaaaaaguaaaaaaauuggccaggcauaguggugcacgccuguagucccaguuacucaggaggcugggguaggagcaucucuugagcccaagaguuuaggagacugaggugggaggaucacuucagcccagaagguugaggcugcagugagccaugaucgcgccacugcacugcagccuagccaacacagcaaaacccugucucagaaaaauagauaaaaauuuagaauucuacaaucugauugacucuaauuuaguuuguuauccugcugauaggcauuuaguuuuuuucugauuuuuucucacuauuauaaauaauguacaauggauaucauccuuauuauguguaucucucuguucacauguaaaguguugagaaggacagaagcuaaagucagcuuuaugacagaagucauaaaguuaguacauuuaaaauuugaacggauacugccaaacucuccauaagaaggguuuuggaaacucuggaauuagggguaauagagcagaagagaggaggaguggaggugccggcaagagaggcagagcuggggacacaccaucucucagccagguacuccugugcugccccggcaaggucaacaugucaaucuuccagauuccugagggccuuuguaagcaaugccccuacaaccaaagccgggaagagagugaauaggacccucugagccaaagacacaaaucuauuucuaacucaagacaacuuaaaaccacagcuacggaggucugaacuuucguuucggcuagaaaauacggcuauggccccacacagaauacagggucuaacagaagacacugugcugcccugaggugaacacggcugauggaaagauaucucuugaacauagaaaugugaaauuucuauaaagagaggacuaaaugcugaaacaugcaggucuuucuauucuaaccauuuagagaaaacacaugcuuauagucuaagugagccucaaaucugcuaguuucuuuuuuuuucuuuucuuuuaauagagaaggggucuugcucugucccucaggcuggagugcaguggcacaaucauagcucacugcagccucaaacuccuagacgcaagccauccucccacuucagccuucccagaagcugggacuagaggugcaugccaacacauccgcuacuuuuuuacuuuuuguagagacaggguuuuaacuauguugcacaggcuggucucaaauuccuggccucacaagauccucccacugcagcauccccacacugcugggauuauaggugggagccaccucacucagccaaaauuagcuugcuuucuucuuaaauguguggaccugaacgcagugguaauacauuauuugcaaguucaacuauuuacauaacugucucccguacuuuuuuuuuuuuuuuuuuuuuuugagacagggucucacucagucacccaggcuagagugcaauggcacaaucucggcucacugcaaccuccaccucccuggcucaagcaauccucccaucucagccuccuggagcagcuaggacuacaggugcacaccaugacaccugacuaauuuuuguauuuuuuguagagacgggguuucgucauguugcccaggcuggucucgaacucuuggcucaagugauccucccaucuuggucugccaaagugcugggauuacagacaugagcauauaauuuguaaaaauccagugaauuuagaguuugcauguauaaucuucauuccguacuauauguuacaugacauacacauguauuacagccuagaguuugagcauccacgcacucauucccaacuacuaugugcagguauugcucuaaacuagggggauacgagcugugaauaaaacaguuuaaaaguucaugcuaaaaagagcuaacguucuacuagugaaaugcuguaugcacaaaacuaugcucuacuugauggauauuugaaguauuuucaugguuaauucggacuagucaugauguuugccuuaggcaggacauuaggaccuaauguuccccaaaagauaggacucuacaccaaaccuauaaccucaagauuugagagccccauuaccuguuccccaguucuagugaugggaaccaguacauggcagacauuuaaguuuccggccccagcaucuuucuuauaucagaccuggaauugaaugauggugcccagcagcuggggaacuagggugcccagacccucauuuucuccaaccccacuucuuccuggaucaccaaaugcuugguuuggauuguuaaaguuuaggagaggccauuguuuuugacuccugcacuaggccccagcagaccagaccgaaccaaaaugaagccacuuguacuaagugccacugaauuugggggccaguuuucuuuaaaaacaaaaaccaaaaaaaaaaaccacugaaagauucuagucaaugugagucugccuaauaaggaaauccucuguuuuaaccuuuuguucuguuucugcuuuuuuucaagccuuuucugccuauaaagacacccuccucugcucagcuaacuggaacagucguucuacuucacauucuagaaucacaaauaaaauccauucaacuuuccaacuaaauuuguaauuucguccuuugacagaauauauaaaaagaugacuggcugggcacaguggcuuacaccuauaaucccagcacuuuggaaggcugaggcaggaggaucguugcuuugagccuaggaguuugagaccagccugggcaacauagggagacuccaucucuacaaaaaaaaaaaaaaaagaaaaaaaaaaaagaaaaauuagccaggcaucguggugcacaucuauggucccgguuacucagcaggcugaagcagggaaucacuugagccccagagguuaagccugcagugagccaugaucgugccaccacauuccagccugggcaacagggcaaggcccugucucuaaaaaaaaaaaaagaaagaaaaaaaaaaagacuuuuuuuuuuuuaacuuguaaacaauuugccauuuauuccaaaaugccauauagacauaauuacuauuaaacaugucauacuaauuuauugccacauuauucuuaccuagucuacccacuaugugguucauacagccuagucaguuaccugcaacuuaagcaagaacucugguacucugagcacaauguucaggucacugacguuucccuuuugagagagaugggagaauaacugcacauaacgcauauaagaccauggagggucuaacacaggagucagccaacgacagccagugggucaaauccagcuagccuccuaguuuuauuggaacauagccacacugguuggcuggccaugccauuggcuggcauauuguuuuggcugcuuuugcacuacaaaggcgagagcugcuacagagaccacagggccuccaguguguacuagcuggcucuuuguaagaaaagucugccccaccccugcgcuacuaggaagaauagaugaggaguuguggcuaacuguuaacugccuaaguacaaaugcacauuucaaaagcaagugacaacuggugauaacuuacucuacaaaucaagagccaaaagagcagcuccuuugggcugcgguccagcugucccaacccuccgcuccugccuucucccaugagacucuucccuuccucagggcuguccucaaauggaacuugggccuuaagugaaucaaacuguguaucucccauaugucauuuuuuuuuuuuuagcagaaaauaaaguaccuuaauuuauccacccacagaaaguuuuucagauggggugggaaggaauggagagagaaugugucuaugagcuuccagcgcucaucucugcggcucagaagccaucaauagcucgaacagaaaacguccucacaucugucacacaaacacaccccauggaaccaaaaauaaaccccacacugaugaaagccagcaugucgaaagauaauuuuagaucuauuugaagacugcagagacugucucgcugaaauuuuaaaaccacaccaccagaauacccaaccccuuaugauuaugcucagcccugaugaggaggcaaaaacacuucauuccauuuuauaaaccucccaggcaccucagcucugucucuagaauggggagagagcauuccugaguuaccacgugacuccgaaggucagccgagucacaucugagccaacaccacuguccaauauucacuaauggaguucacauauuuuuagcuuucagacauacacagucuagcaucacaggcuccuuccagacacacuugccaaacugcucucuuuuccccuaccugagggccagcucuauggggacaauaacuguguguuacucagugucucugaaauccccagcaccuuucagagugcucgccacuugcaucugaaagaaugacagcuaggcaauuuuuuaaacuuuugaagaaugagcucggauuacaguuuaaucaagucacagaaucauccuauuaaauuucuaugcagaguaaguaucaagauucagccauucacaauaucuaugcauuguuuccuguucccaucgcucugaggcuacuuuuucuuccauucuucguugugccauuucucuguucucuccagccccauguuuaugauggcugacaaugcucauuuccaaagcuuuugucuguucuauuuaucugcaggcuacuccgaggcccugucuguggacaguugcuuaacagacgcuuuagaugacuacagaaaaaaacguguuaggaaaacuuucauucucacaucuuaucauucucucucguccauagccagaccaauccuaaaagagauccagcugacaccuggugcucccgcaaacgugcagguaauggauccucacagaccaaggacaguauguauuguuuccaauuuccugccuccuggcaagcucauuauuacuggaccaggaucaaaccucuuuguccuugguucaggcucaaaaaaagacucucagcagaauauccauuaguucaaauugcugccuccaguacaaaacgauuucccaccacuacuucccgacauccacuuguauggggaaggauaaggcccagcaaugacagcugaggcauaggaggguacagggacuccuugcuuucucucacauguuaucuccggaugaaauuuagaccaaaagauaaaaccguuuggaaacauaugucuccagagucauccuaacuuggaggggagggaacucagaggauuuaagaggcaaaaccucaaagccagcuccccagaggaaaauucuaaaaggucauggugagaauuuucccucaguucuacaaugggcuugagguucgauggucccaacccacuuuuaaucucaaaaacuuccuccuugauaacuugacacauaagguacaacaguaccaugaacucaguugcuacgcagaaagagaacuuuugaaaagcacuccaucucagcuggauuuuaaaaaagcauuccagaaucaaagaacugggucagcaauauuuucuuguuauuguuaauuugacacuuguucugacacaaaagcauauaagcggagaauggagagaguucuacuugaggcuucaaugugccuaugccagccccugaugcaggucucagguacagugugcucugaacauucaaccaguaaauaucaaaggaaaaucaagagccagacucuccagcuucagcaugaagaccugucauuuuacauugggacaaacugcacaguauuuuggaucaaagcggaauauuuuucacugaugauguuuguuuuaaaaagaugguuauaccaaacacaaccugaaaacaaguucuauuuuacauguaaagccacugaauaaauaaauacuaguuuuguggcuaccucuguuuucuacuucagaauaacagucaucccuugagcucagcuuuuggucaucacaacaggaagcaggcagaugggaaauguaacuaagcuaagaucgcugcugagggccccaggcagcgcuauuuccaaaaguaauacuucuuaccacugggcccagaagaaagucuagaaagcggaggaaggauaugcuugauaaaaggcauuuaacugugacuucugugaauaucugaccaacaagcaaaccuaguugcacaaacaggagaugcacuggccaggcgaccagcagcccuggguucuaaucccagauauaccuggugucucaguucugacaagccacuucacuuccugggccacagcuccucaccugucaaacgacagguuuguuaagaugaccacuuaggacuuuucugcuuuuaaaaauucuuaacaaugggccaggugugguggcucacaccuguaaucccagcacuuugggaggcggaggcagguggaucaccugaggucaggaguucgagaccagccugaccaacauugagaaacccuuucucuacuaaaaauacaaaauuagccgagugugauggugcaugccuguaaucccagcuacucgggaggcugaggcaggagaaucccuugaaccugggaggcagagguuguggugagccaagaucaugccauugcacuccagccugggcaacaagagugaaacucugucgcaaaaaaaaaaaaaaaauucuaacaauguauucaaauuauauccuaagcaauauaucaauguaacaaaauuacacuuguacccccauaaauuuauacaaauuuuaaaaauaaauuauauccuaaaaagaucauuguuuucucuguagaacacuuaacaccacacguauuugcugucucuucucaaggcagaacacuugcuauacauacgagcugcagccuuuuuccacucaucucuuuaacucgcuccuuuaaggggccuuguuucaggcauuuuuggaucccuggaaccaguacaagaagggcuucccacaaggaauauuuaauauuauggcuucauauuuauuuuaauucuucaguuuaaaaauaggaaauaaaguagcucaucuccccaguuucagaguuucaaacauaacggaucaaagaacucugucaacuccaagaaccacagaaguauuuuaacaugucacuguaaacagacuaaaagaugugcuuaugaauagccuuuggaaauccaaguuguuuuuaaguaaaguagccacuguauucaccuacagucacuacacuguggugaccccagaauuuagaaauaggguaucaucugggagaaauguagcaaacagcaccuucagcucagccuaacuaacgggcuaaguuaucuggagaaagaagucugagggcagcugggaacaucugggaacuacucaaguucaaacaagguaaguguaauaugcaacaccagggaggguggcauggccaaaucaccgugacugacuggaaugcagaguggaagccugagacuuuuaugaccugucuggggaaaaguaugcacaagaucuagaaaaacggggaugcaggaagaaagaaucuaccaguguccucagcacuguccugagugaaggguguuuuuacaagcagaugcacauauggggaugaucaaagccagaaaugaacaagcugccccaggggaaagcaagcgaacgggaagggcagagggcaguguuagaggcacaggcaaagaggagaugaccaccucacacacacuauagcgacuaaaauaaaaaaaagauguaccauuaaguguuggugaggguguggagaaaugugaaccuuaauacaugacuucauccugaauaucccacauuacuggugggaauggaaaaugauguagcaacuuuggaaaauaauauggcgguuccucaagagcuuaaaauuacuacacaauccagcaauucugcuucuagauauaaacccaagagaaaugaaaacauauguccauacaaaaaucaguacacgaauguucacaggagcauaauuuauaauagccaaaagguacaaacaauccaaauguccaucaacugacaaauggauacauaaaauauguuacagguauauuuacagucgcaacacuuuuggaggccaaggcgggcagaucacuugaggucaggaauucgaggccagucuagccaacauggugaaacccugucucuaccaaaaauauaaaaaauuaaccgggccugguagugcgcgccuguaaucccagcuacucaggaggccgaggaaggagaaucgcuugaaccugggaggcggggguugcugugagccgagaucacaccacugcacucuagccuggguaacagagugaaacuccaucucaaaagaaauaaauaaauaaaaguaaaauaaaauguuauauucauacaacagaauauuaucuagccacuuaaaggaaugaaguacauaugcuacaaccugagugugaaccuuaaaaacaugcuaagugggccaggugcgguggcucacgccuguaaucccagcacuuugggaggccuaggcaggcaaaucaccugaggucaggaguucgagaccagccuggccaacauggugaaacccugucucuacuaaaauuauaaaaauuagccgggcaugguggcaggcaccuguaaucccagcuacucgggaggcugaagcagaagaucgugccacugcguuucagccagagagacagagcaagacuccaucugugagagagagagagagagagagagagagagagagagagagagagagagagagagagaacggaccagacacagagggcuauauauuguaugauuccauuuauacgaaaugucuagaauaggcaaauccacagagacaaaauagauuaguggcugccuagggcuggggagcuugaggggaagauggggagggaguggagaguguaauguggaaugaaggaaacagaucuaacauguuucaggcugggaauaucuauggcucuuccuacauuggccuggcacauugagcucucaggggagaaagugggggcugcacaggucacccauccuuccuucuucaguacagguuuuaguggccccuacucccuaggaaauaaagacuuuccuuucuccucccuccccaaacacccauguggcuucccagggugccuaaaucugaaucuuccucaaacacagacguuacaccuugacuuagcguuuggguugggaggcuuuacuuucuugcccacuuuuguucccuuugcauucuacauucuaaaauggacuuucuuuuugagacagagugucacucugucgccaggcuggagugcagugccgggaucucggcucacugcagccuccaccuccuggauucaagcgauucuccugccucaaccuccugaguagcugggacuacaggugcacaccaccacacccagcuaauuuuuguauuuuuaguagagaugggguuucaccauguugguuaggauggucuggaucucuugaccuugugauccgcccgccucagccucccaaagugcugacauuacaggcaugagccaccacacccggccucuaaaauggauuuuuaaucccccagguaucaaaucucaugaguguguaccugcuuaaauuauacaguuaauaacaagaaugaccugcaaaauaaauagcccuuauguuuugagauggggaaaugcuccaagagaagacagaaucaugccuuauucaaccagcacagucaagcuuucucugagccaaaguucuccugggaaagaggaguuucccuaaagaaaagaagcaggacaaagucuggcccagcaucccuugcaguccccucuuacucaaacuuaaacacaggccacauucugcaaccaaggcaaaaacuggaaauaacugacaagggagcugcccuugcgcuccuaacccacauaccaaagacccacgcgacucuggcagaacgcuggguaggaggcacuuacacacucccauccgggccguuacaagcaugcaguucuuucuccucuuccagucacagucucaggcacuuccacggccaacaaagaggggguaaggacuccagcaggagcccagugugcgucccuacaaggggaccuuucaacacccgcccgcaagcacccccugaggaugaggucagccucucuucuguaggccacgaaacaagcugacuuuguggccagauggcagcucccuugugaggcccuaaagcuggaaaaggauugguuucacccacagggaucucauucccuacgcaggacacccagccaaaccauuuguaaauagguacauucaggggacaggcauagaaacauuuacaagagccucugugagggacaucaggguugccuucccucucuuccucccucucucuguucucugacuguaagucacccugugcccacugccaccacuaccucuaggcucaccucccaaaauaucucccucuguuuccaugauauagccuccugcucuagaaucuguaauggcuucccacuugccacagaccacauucaaacacuucaccuuggcacuacaauuccugcaagauguggucauuucaccucgccucaccucuugguccuucuccaccugccucucccuccucucuagucacacagccucguagcuaagaacauauucagaccagauucaaauccuaaccccaccauuuaauagcuggagaccuugggugagguacuuaaauggcucgauguuucaguuuccccaucuguagggcagggguaaugcuaguaccuacuguucaggugaguacagugcugaugaaguaagaaaauacagggaaagugcucagaauaaaaccugacacaugguaucacucaauaauuagcuauugaaauaguuauuauuacucauacaagucacuuauuucacgaagccuuuccuagcaacaccaguggaacaucuucuguuucucaaaugauccguuaacagucagaaagcauaaauacugacuggaauugcuagaacugcuucauggggcagguuacuuggaugguaaucaggugugaauauuaucauuaugaaauucacguccuaaaacacauaccaauggcucccaaauuaucucucccucuaacgucucaauaaauucaccacugugggauacuaucuauuuguuuaguaauagauuuuguuuuuuggaugcagggcuuaauucuauuaaagaauagcaacuuauuaagagcagggaucacacuacaaccagugcacagcagaguucccaccacaguaccacaguggaucaucaagccaccuuaauggauuuagaaauucaagcuuguugaauuuacaaagaguaaauuuaaguaauuuacuguauuacuuaaaaaaacacaaguaguacaugggagauuaaguggacgcucagaauaagaguuaaaaucuacgcuuucagauagaaaaacuagccagcaugguggcucacgccuguagucccaacuacucagaaggcugaggcaggaggaucgauugagccugggaggucaaggcugcagagagccaugauugugccacugcacucuagcuugggcaacagagcgagacucguaauuucugccuuguuuuaggccuuagaagacuuuauaacuuuggcugggcacaguggcucacgccuguaaucccagcacuuugggaggcugaggcaggcggaucacgaggucaggagaucgagaccauccuggcuaacauggugaaaccccgucucuacuaaaaaauacaaaaaaaaaaaaaauuagccaggcgugguggcaggcgccuguagucccagcuacucgggaggcugaggcaggagaauggcgugaacccaggaggcagagcuugcagugagccgagaucgcaccacugcgcuccagccugggcgacagagcaagacuccaucucaaaaaaacaaaagaaaagaaaagaaaaaaaagacuucaucacuucucuucugaauuauaagcuccauuucucgcaagugugaacaccccacggcuagcacuacagugucuuacugaagaaagagccaauguuucaagcagucagaggggaacccaaauuucacuguaguauccaccauauccaagaccauacaaccagaauuauaaaagcacuaugcaacagaaagcuucagaaggccuauuuuaaugaauaagaauauacaaagugcuguuaagaaaaugguuguuuugaaauacuugaguguauuuaaaauagcccuaguuucaggccaggcaugguggcucacgcauguaaucccagcacuuugggaggcugaggcgggcagaucacuugaggucaggaguuccagaccagcccagccaacauggugaaacccuaucucuacuaaagaaagauacgaaaauuuagccaggcaugguggcacgcgccuguaaucccaacuacucgggaggcugaggugggagaauugcuugaaccugggaggcggaggcugcagugggcugagaucgcgccauugcacuccagccugggcaacagagcaagacuccauccaccacccccccacaaaaaaaucaucaaucaauaaaaaaaauaaaauagcccuaguuucagcacagguuggggcaaacguuugcucagguguugccccgggcaaugucaucccuacugugggcagcuccaucagagccugcuccggacuucccuccaccuccucacuuguucagcugggaagaugcaguacggaguggucgguuguaaggggaaauggcauuuggauagcaaggcuuucuucucccucuaucucuaggauaagagcugccccaagggaacacgccugcugcucucucuuccuggcaaacugcgcccuugcaaagaagucugcccuucccgggcacugauggugcccugcugggugagucugagucauuuggggguucaguaaaagccugcuucccugaagauaugaaccacagagccucacaucaguuuuaugaggaauaaaggugauguuuggcaaccugcugacaucuuagucuuuuuugucaauucgcuuagaaccuaggagacaaaguguuauuucuugggcucucucaaaauccccaccacaguccccugugauccaggaggacuacuaugggggaaaaaaggaaauucaagaaaaagaggucccacauguaucuccaucagcaucacacaccaggccuacuucuguauacgcugaccaaagaacggccaaaaauccaccccucacccaugaagacaccacucacccuacaaguaaccuguccagaaaggugggaaaugccccauagcccauucuccauuauuugugagaauaucagcuuuauuauacuuccuauguaggccaaauuaaguguuucagcugcuauuugaaauccuggcaggcggccaggcacaguggcucacgccuguaaucccagcacuuuugggaggccaaggcggguagaucacuugaggucaggaguucaagaccagccuggccaacauggugaaacccugccucuacuaaaaauacaaaaauuagcuggccgugguggggggcaccuguaaucccagcuacuagggaggcugaggcagaagaaucgcuugaaccugggagguggagguugcagugagccgagaucaugccauugcacucuagccuggguaacaagagcaaaacucugucucgaaaaaaaagaagaaagaaauccuggcagccauccuaugacaagggaaaaggacagaaggguacaagaaaagauaguauauuucaucaggaacagcuauaaacaaugcuaagauaaaauacacaaucgucugacauaaacagacgauugugauggacaaugauguguccaugauguguccaaugauggacaaugauagacaauggagacucaggggcuguggggcugggaaggggguggaugaugagagguugccugguggguacaacguguguuauucccgggauggaugcaccgaaggcccugacuucaccacaagguaauauaucaacauagcaaaauugcacuuguaccccauuaaucuacacaaauguuuuaaaauuuaaaaauuaaaacaagaauucuccaccaaaagcaucagauagaaucuacacuacuacuaaagaucaagcuguugauugguuuuccuguuuagccagaaggcauuggauccuggaaagcauagagcaggcuucaggaagguucaaggaaaccagguauaccccaaaacacauggggguacauggaccccaucuucuaaaucauguuuuucccacacacccucaucaaacaucggaaauaggacgagcugaacacggacaaacuuacgugcucuuucaucuugugagccacgguuguugacaucaugaugcagcagaggacgacgaccagaaugaaguagagggcguacaugaagcgggugcugagggacugccgaauccuggggcagcaaucacagcagagagagcagccugcagacccacagcagcaggccagcuagaaaaggaacagaaggcaucugcuuagagcaugauacugugauagaauaagaaacauggccaggcacugugguacacaucuggagucccugcuacucggggggcuggaggaucacuugagacuaggaucgcuugagaccagaguucaaguuuagccuggucaacacagcaagaaccugucucuaaauaaauauauauacacauauauauauauauguguauauauauuuauauauauugagacagucuauaucuaauguauauuuuauauauacauauauacauacacacaugcacauauacacacacacacacauauauauauuuuuaauaaggcccagugcagugauucacaccuuuaaucccagagcugugggagaucaagguaagaagauugcuugaacccaggaguuugagaucagccugggcaacacagcaagaccccaucucuuacaaaaaauuuuuucuuuaauuagccaggcaugguggcacaaaccuguagucccagcuacuugggaggcuaucuccaugaaaaacaugaccaggaaaaaagaaaacaaucauauuagguuggugcaaaaguaauugugguuuuugccauuacucuacauauauauauacaaaaauuuggucuggugcaagggcuucuaaaacuucuggaauuuccugagugacagagguuaacaggagaguauuucguuacuaaugcucuuuucagucauaccagagcuuguacuaaugaggcaacucuuccugggucccuagauagcuucaggauggaaggcuggcuaucaguggaaccaaccaugugguuuagagggucggaacuuucaggagcacacaccugggcagggacugaagacugagcuaauuaccaauagcccaugauuuaaucagccgcauguacauaauagugccuccauaaaaacccuaaucaaugggauucagagcuuccaguuuggugaacgcauccaugugccuggaggguggugcacccaaacuccaagggaacgaugcucuggcgcucgggacccuuccggacagugcccuguguaccucuucaucuggcuguucauuugucuccuuuauaauaaacugguaaucgccaguaaagaguuuuggugaguucugugauccauucuagcccauuauugaaccuaaagaggggaugcugggaaccccugauucauagcuggucagucagaaguauggaaggccuagauuugcaauuggcaucugaaaugagaaaagucuuguggaacccagcccuuaaccugugaggucugugcgaacucuagguaguuagugucagaauugaauuaaauugugggaugcccaguugguguccuguacugagucacaccacuuuaccaacguauucacccaggucuucuguaggucgaccuuccaagcuacaagaugaacauucuucccagguaccuugaccauaggacaugcaggaacaguucggugugugaacaaagcuuucaucggaauuguucuggugcuaucuuuaaugacaaccaucaaugguuugggagaugcccaauuauuacacagaaaaggcacaguucaucugaaguauuauaaucgugacucucagacaaaaagauuucuacaaucagcuaagagcaagagaagaagccaagaacuaguaaacaaagugggaagaacaugaaaaacaaaaaguugggcccaagaaagugagggagaagaaaaggaaaaaucaguuaggcagacaguuaaggcuaguccucagagaaacagacugaaaaaucacagcuacacauacaaauaagaguugccuggggaaaaacaaaacugcagcugcacugauaagaaagcagggcccagcauagaagccuuuuguucuuugugugauuagcaggcucccagggaaaaguuuccucuccuucucaggcacauacacggugggcuccgugggaacuugcacagggaguggggaggugcugggggaggcuuaccuaaaacacaguuacacaaaugaggagcugcacuuuguguuuacccaacacaugcccgugucugcacugauaaggagaguuacacagacagcugcacagauaagggaacuuaggcaaacagcuacagagaugaggggaguuucucauaaaagcuuucagacucaacuguaaaaacagcgacucacucagguccuccuuuccauugcacagagcuuucuucguucacuccaacuucacccuuguguucauauuaauccuuacuuuucuuggucgugagacaacggacuuggauaacaccucggacaacaugaccaucaacccuagacgguuucaaaaggaaccugucaaaauccaugagccuaaggaugaauguacaagcacccagggugcugggaugggaaaggccugcagccauacacccuuguaggaaauaaugagaguauguaacuugaagcucaaaagaaaugggugccuuuuacacugcauuucuaccagaguuucaugucccaaaugguaagcuuuuuggguuaaugaguaggacgugggcccagaggagcacagagcuccugcuauaccacuaacagcauacacaucuuuucuuugggaucuuuaauaaaccauaagguaauagaggauggugauuaaaagcucaggcucaaagcuuggcuggguuuguggccuggcuuugccaccuacuagcugugaacuacaagcaaguuauuuauccuuuaaaaacucaagacuuggccaggcacgguggcucacaccuguaaucccagcacuuuaggaggccaaggcaggcggaucgugaggucaggagaucaagaccaugaccauccuggccaacauggugaaaccucgucucuacuaaauacaaaacaaaacaaaacaaaacaaaacaaaaaacaaaauauuagccgggugugguggugcacaaaaaaaaaaaaaaaaaaaaccucaagacuucucguuuauaaaguggggguggcagaaguacuacauggugucuuggauaaccuaaucagacacaacuggcaccagaaaggagucccuguuaagccaacagggcaaugcuacaagaaauuaccauaaacugcagauuacaauaaaaucuguauguauuaacacuauacucuauauaaaccuaaagcccaacaauucaaucuuuugauaaugauuuggaaggaaguuugagacucugcaaggcuucaaaacaagcaucaauuagaaugcuacaccauaaacaucacuuacaaugagcuacgaucacagguauauggguaagacaacauaccauaaugguaugacagaucuuggaaucacagucauuucccuaguuaucucaucuacuucaugagacugucauuguuugagcccugugucauucucuacuguuucaucacuacaaauuuuuccuaaccaacucucuccaucuuacguccgauuuuccaagccagcuuccuccagauucuucuugacucacaaaacuaagccacugcuuuguaaaagaagacauucuacucgggcugagauaagagaauacacaagugguauccuaacauuacugcauguguggguguuuuaugggccacuuuccuuuacaauuccuucacugauguucucaaucucugauuuuacugaccucuuuccacucacaugccccaauuuuaaacacauacacauacaacuguccccuccccacugcuuuagcuggcuuuucucuggguccugccuccugaacccuuuccuaacugccuccuucacugauugcuuuuuuuuuuuuuuuuuuuaagagacagaguuucauuguguuacacagacuggccucaaacuccugggcucaaguaaugcuccugccucagccuuagcugggacuacaagcacaggacaccaugauaccaugccuggcugguugcuaacucucuguuacccuguggucuuagauaacuucucacuauauauauauauauauuuuuuagacggagucucacucagucgcccaggcuggagugcaguggcacgaucuuggcucacugcaagcuccgccuccuggguucacaccauucuccugccucagccucccgaguagcugggacuacaggcgcccgccaccacgccuggcuaauuuuuuguauuuuuaguagaaaugggguuucacuguguuagccaggauggucucaaucuccugaccuuguaauccgccgucucggccucccauaaagugcugggauuacagguguaagccauggugcccagcaaccucucacuguauuucaaguucaaaugugaucaacaaaauacuuauucuauuugggaaaauaaguauuuuggaaacaguuaaugccucccacaauaaaacauucccacagcugaaucaacauuuaaacuuacuauuaucuccacagagggaaaaauaaacagauacaaacaucacugugagccuaauuggaacugaucaucuaaaggcagacaaauagcaacagaagggacaugauuguggaaaauguaaaaagaaagcccuauugguuuaacccuauucugucauuaaagucauaugccauuguauggaucugauuuuccaaauuucauuuucacucuuacucuauacagugcuaugguauuacaaauauacauauguacauauauaugugucuauauguauguguaccuauacacacacauuccaaauauuagaauggacuagccuuucuuacuagcccaaaagugauuuaucaaaguaaacuaugcuaauaauuaagguucgagcacauuaucuuaagcuacacauugauauauauaccagguggaaauucaaaacagcauccguaaaagaaacauuuauguuagcaucuagggaaaucucacagcccugcugacugaacacguguuucuggaggagcauaccuuugaauaaaauggguucacauccagccccugccaccuacaggguuaagacacugagcaugucacucacuuucaaaacuggaaaaaucaauuccuggcuggaacuacuggugcuuucacaagcuuggagagaagugccaggguuucguuaccccuggcuccaagagggcauaaagcuuuuacugaaaaaguuacagcauauaaaaaacaaauaaauauagaauauacaacgccaagagggaaugcuaauguaaaccauggacuuuaggugguagugaugugucaagguagguucaucgauucuaacaaauguaccagucuggugggaggagcugauaaugggggaggccgugcaaguggggaggggagguauaugggaacucucuguaucuuccucuuaauugugcugugaaccuaaaacugcucuaaaaaaaaaaaaaaaccuaagccuauuuuuuaaaaauauaaauaaauaaaugaacaaaacagugccugcccccccaaacgacucaguaaauggauguuggcugaauaauguauggugaagucacaguggcaacacuccucacgcacaguggcuggcaaucuccuccaugggaacaaguucacaauugcaugcuauacucaauuucccacgcaagcacugaaucacagagaauacuaaggguguuaauuuguagauacugcauacucuccuccuccaaggaaguaacauucacacacgcaaaagggaguccaacaacaucuucagagggcaaugcuugcaauccuuccagaaacuccucucacagauacauuuccaaaaagacacagagauuuagguaugaggcuguucauaacaaacacuagaaacagccuuauuuuccagcuacccagggacuaguaaaaugaauuacgaccuauacaaugaaauauuuguuaauacgucagguguguugggcuaaauugugucccccaaaauucauauguugaaguacuaaacccuaguaccucagaaagugacuguauuugcagauagggccuuuaaaaagguaauuaagguuagaccaggcgcgguggaucacgcauguaaucccaacucccaaagcgaguagacugcuugaggccaggaguucgaggccagccuggccaaccuggccaacauggcaacaccccgucucuacuaaaaauacaaaaauuagccaagcaugguggcacaugccugcagucccagcuucugaggagucugaggcacgagaaucgcuugaacccggggggcagagguugcagugagccgagaucgcgccacugcacuccagccugggugacagagccagacucugucucaacgaaaaagguauuuaaaaguuaaauacgaccacugggguggucccuaauccaacaggacugcuucuaagaagaggaggacacacacacagggacagcacaacaacacgguggccauguacaagccaaggagagaggccucagaagaaagugacccugcacacaccuugcucuuggacuucuggccuucacaagugagaagcugaauuucuguuggguaagccacccagucagugugacuuuguuaugguggcccuagccaacuaacacaggcaguacgcccugcuauuucauaucuauguacauacacauauguguagauacaagaccacuaacacugacuacccgaggaacaggccuagauguggggaagaacaggggacaucuaugauacuuauuguucugcucuccugguuggguuuuuaccaugugcaugcauuacucuuacaguuaaaaaaugaagaaaacugacuacuugagaaaaguaaacggcgcgugguggcucaugccuguaaucccagcacuuugggaggcacccagcacuggguaggcggaucauuugagcucaggauuuucagcccagccgggguaacauggcaaaaccccaucucuacaaaacauacaaaaauuagccaggcaugguggugcaugccgguggucccagcuacuugggaggcugaggcaggaggauugccucccaaauagcugggaccacgggucgaggcugcagugagcagagauugcaccauugcacucuggucuaggccacagagauccuaucucaaaaaagaaauaaaauaaaagcaacuaaguugaacgauagugauauaaaagcauuugcaaaugugguauugcuguauguugggcuuuucccuucugaagaagcuuccccucccgcaaacauacugcaaaggaaaaucuuucgaagagccuggcacauccucccuccaaccgcaggaauggcaaaggcuuuucuaaauaggaggugcuuuguccuugccggggcaaagaaucaaaaugaaaggauaagcugacucuugcuuaucuuaccugaagcugggccucccacuuacuguuauuuuucuucuccaaugaaggaccagccccgcaacacacacacauucuacaaaaaauaaauaugucucccucucuguccuccgcaccagccuugggcacagaugguccuuccaaggauugaucuaggugugugaggaaaugcucacagaaacaugagcuagggcugguaguaacuuccaaguacuacuucuguuaaauuaaaaagcacaauaccuucauuaccuagaauuuccagcuggcaacaagaaggccaaacauauuacaaaaucggcaugcacacacacacaacacauguaccuuaaucauaaaagggucucugucucccucucucacgucuuacuuucacaguuccaaaggccugacuaccagguucuuaagccacagcaaccaagaggacaaacugcuggggagaaccagagaaccuggacucaacucuagcgaagugaccugcccuucugggucuuaguugucaucacuuguaagucgaagaagcccagguagaugacgggugguagaucaacagguuucaucucacauccaacggaugggcagcggcugccugaaacucugugcugaggaggauucuuaaggcugaaugucucagcagggaaagugcaaugaucacugaguaccaucugccacaggcauggaaagagagcaugguggcaucacaccacacuccugucaacccugcaagagguaacuggauauccuuagcauccauaacuucuuagauguugaaaaacaaacugcaacaggcaagcaugaugaguuaaccccagagcaaggaggagagaaaagcaaccaaaaggagaagccagaacuaaaaaguggagcagcgguaagcucuucaagcacacgugagacaaaauggcaaauguaagaagccacguuugcuuuucugcugccugcagaauuuuacaaaaucccuuaccagcaggauuccacaaagccccugacucugaccgagugcagcccuccagaagaaugcccugaagaugaucagcagcacacagcacagguucccgagucucuugccugaaucagguuaaguucaaugacccuaacccuugccucuuucuguacaugucugacaggauuaaugacuaugccucuaucaucuauaaccacaugaacuccugugcccaaaccuugaugagaucuugcucuaaucuaacuucgagcacaucuguuguaacuucugagcacuggaagagccgccaucaccugucuauaaacugcgggcugaaacucugccuuggagcagucuaacagaaacucucugaaaagacuaacagguugcaagcuucagcaagacuucugaauaaacuaaguugaugugaaagccugauuuuucuuuagcuuacacacaggucauguaagcaucacucuauugcugcauggucuacguucugcaugguaacagcucacacacggcagugugaucacucauauucacgacaauggcccaggcagcacauauguucuguuaccuucauuccacuuaggaaugaaagaaguauccuaagcaaauaagugcuuagaacaguucugucacaagaaugaucccaaaugugggucacaguuuuuagcuucagugcuugaguuuuggggaguaugaaccccucggccauauggaaaccaacuauucugaaggacuugcuccucaacggggcuggacagccaaguuggcuuucaugugucuaaacuaaguccaaaccguaaaaggaagugugacaccacccuucauucagucccuuuuccuaauucuggaaauacaggagaccuaccaaagcuaaggaaagacaucaaguuuucugugagcuacaaaaauuauaauacuguuccuuaauaaacggcagugggauggggcacaguggggaaguuccucaaauacugaagcugaccaagcuguuagaacucagguguuccugagcaugcugggagguuauaguaccaagguaauagaagacauccauuaaaaacauaaaacuggguucaaaguuuuuuauucaaguaaacaacacugcaucuuuuaacuacagaguuccacaccuuucaguaauacauaauacugcccaugccgugugagggccuccuucccuuccuucucuuuugaagcuuuaggguuaccuuugagucaacuguggucugcagaagaaaugaacacuucucuacuuuggagagcaacauucauugaaauucuggacccaacaaccaacauuguguggcuuaaucuucccaucucaagcucagaaauagcuuccacugagcuuagacagaccuuucuucccacuacaaaagggcagugguggggugggggggggguguugguaaacccucccucuuggcaccacagugccagguacuguccuuuauugauagcuaugcaauggcauggugcaacuuaaaagcuagaagaacgagcacaaaaauuccucugcucaauaaaggaguguuuuacugaacaaacaguguaacugcagguaguuccuaacucacaaaugguuguauucuagaaaacucaacacauacacaugugguuuaucuggggcuuacaguggcuuucccccauacaaaagaauacauggcaacccaugaaagcuuacugaaucagccaggcacagugguucacaccuguaaucccagcacuucgggaggcugaggcagguagaccacucaaggucaggaguuugagaccagccuggacaacauggugaaacccugucucuacuaaaaauacaaaaaauuagcuggaugugguggugggugcuuguaaucccagcuacucaggaggcugaggcaggagaaucgcuugaacccaggaggcggagguugcagugagcagagaucgcgccacuguacuccagccugggcaacagggcaagacugcaucucaaagaaagaaaaaagaaagcuaaagcuuacugaauccaucauaauauuaguuagcaauaguuaacacuuauuaaucucuuacuuucugcaaggcacaacaauuauuauuaccuguuacaaucaucccuauuuuacagagacgagaccaaggcucagagagguuaaacagcagcuuaaggucacagagcccgcaaguacuagacuuaauuuaaaugugguaggcucuuugccauucuucuccacuuacugcuggcauaagcgcaugaacaagacagguaacacuggccugaaacuggcuucaaaccucgguuuccuacaggagggagacaggcuacacuggaaaaaggaagcaauuuuucuucccugccccuguguguacaguaagcauucagcaaguaucugaagaggucacuucccuuucugugccccuuccugucucccaugcaaacucuggccucagugaacauggauggcuucuucuagugucuugccccaagcagcucaaccaccgcaaucaccaagcucccugccucaccaaauccuaccccauauuaaaagcccuauuuccuaauucuauggaaauaaccaggccauucauucacucacuaauauauacuauacucuacaccugcuaugugcuuugucaauuccugggaauaccgcaguaaacaagagaccuugauucuacacucucuaagcaagaaaacaaagauauacauaagaugacuaucuacaugacaucuauuacacaucuaauacaugugguuuaagagaagaaaccuagauguccaauaaaaagauuuagauuuaagaucaguuaaauuacagaagguucauguuguagaauauaauacacccacugaaaugauuauauagguuauacagaaaaauuuauggccauggaaagacguccacacuguauaaacugaaaauaguuaauauuaauaguguagaguaugauagcauuuuggguaaaaauauaacaagacauagaucagcacuaacaacaacaaaaaacaaacuagaaggauauaucaguacaucaacaguaguaaacagaguuguagaauuaugagugacuaugcucuucuguauuuucugaacucucugcaacaagcauacaucuuauaauuagaaaaacauuacagguuucuauuuuggaagaaaacaaaacauuccuguuccaccucauaggugguaagcccucaaauauuuguuaaaugcaucagacaaugaguaaaucaaaccuacuucaaugugauuggaagaaaacagccagagugaacuaucaccauaauugaggcauuaaaaaaacaaaaaaaaaacgaacaaaaaaacaccuccuguacuauacacuugaaaauaguugggucaggagcaguggcucaugccuguaaucccagcacuuugggaggccaaggcaggcggaucacuugaggcuaugaguuggagaccagacugaccaacauggugaaacucugucucuacuaaaaauacaaaaauuagccaggugugguggcaugugccuguaaucccagcuacuugggaggcugaggcaggagaauugcuuaaacccaggaggcagagguugcagugagccaagaucaugccauugcacuccagccugggcaacgagacugaaacuccaucucaaaacaguaguuaagaugguaaauuuuauguaugcauuuuuuaccccgcaagaaaaaaaaaauuccuuaagccuuguaaaacuuuauagaguuuaacugauguaaauaaaccaauacuugguagaauuugaagcaauuaaaaauaaaauaaaaaaauuaaacagcuaucgauauggcuaggauuuguguccccacccaaagcucauguugaauuguaaucccuaauguuggagauggggccugguggcagaugacugcaucaugggggaagauuucugaugaaugguuuaccaccauccacuugguacuguucucacaacagggaguguguucucaugagaucuggucaucugaagugugggauaucucccacucucucucucucuugcuccugcuccugccauguaagacaccugcuccucccuugucuuccgccaugauuggaagcuuccugaggccuccccaaaagcagaaccugcuaugcuuccuguacagcuugcagaauggugagccauuuaaaggucuuuucuuuauaaauuaccuagucucagguauuucuuuauaguaaugcaagaacagauuaauacggcuaccuaaaaguucaagaaguuaaacagaagcuauauaucugccuagacuagaaauaugcucuuauaguuccuuuaucuggguuucuuaaauuuuauuuugaguucagagaauccucuaaagcgccaaggcuuucaucaucaugcccauaacuguggcagcaguauuguggggacugugagagaugaguuucuggcaagugguuucucaaacaaguuucaacauacuagagcgguguuauuuuccacguugaacauuuccaugaaacaaacagucaagggucaacuuaguaucuccagccaccagaaccaagucugaaaugggcaagaagaggcuaugaacgcauacaaagccaucagucagcuuugggguuacaguggagucugggacaaagauguuccccuuuuuuggagucucuuucucaggagguuagggcuacuuucagcaccagaagaauguuuaucaaguccucuguucucagacagcagugggauuauuugaaucauuccaucacaggacccucucucuaccuuaaaauuaaaaauaucauaucacacuugauacauuuuagcagguuggugagaucuauaagguuugagguugaggguaaacaacaucccuucugacagcucaacagaaaacaaacguuccucaggggcagguccuucagagcagcguuucuaucacucgacacuauugacugggggccagaaaauucuuucuugucgggggcugaccuguacacuggaugcugauguucagcagcgccccucccugccucuacccgcuagaugccagucacaacucccccucuccccugcaaggcgugaugaucagaaaugucuccagacaauggcuccccaguuaagagccacugaguuaggggugaaaagcaagagccaucuccacagucagacugugggguucaccaccuucagucugaacacaggagagcaugcuggcaacuuaugugugugagaaaacuuguuggaaagcuaaagccgucuuuacaccuucauuuccacugaggaaaaaacaagagcugugggaacauucacuggcacccacugaggcaacaaauaccuguggcagaacagggcugaaaaggugaguuaaguaaguucuauuaagaaaaagguauaagaaaaugaaaccuugaaacucaaaacggagaaguguaggagacugggagaaaacaaaaguacccauuggguuuuaaauauuuuuuuuuaauuaguuuuagggcugggcacaguggcuccugccuguaaucccagcacuuugggaggccgagguggguagaucgcuugaguccaggaguuugagaccagccuggguaacauagugagacacugucucuacaaaaaauacaaaaauuagccaggcauggugacacaagccuguagucccggcuacuuggaaggcugagguaggaggauggauugagcccagaagauugagguuacauugagcugagauugcaucacugcacuucagccugggcaacagagugagacucugucucuaaaaaaacaaauaaaauaaaauacaguaaaaacucguuucauuuauaaaguaaguuugauguuuacauuuuuauucuuaauuuuuaauuuuaauuuuuuuauuuugauauuuuuauuuuacaaauuuuuaauuaaaauaaguuuauuuaaaaguuuuauuuuuaauuuauaaaauaguuaauuuuaaauagucucagcaaaaaagaaggugggcagaaacccugcucguucuacuuuauaaauaguagcuuaucaaccggcagccagugaaacacuaaacccaaaauuugccucauugugucauggagauuaugcugcaagggagaaaccugccaagcccuuuccaagaggugcuaugugccagcccaauccccaaacccugccaagccacggagugcuuucuaggcuggugacaggccccagugccagcuagaugcccguaugcucggggauggaaacagaaaggagcucauuucacugcucucagagagcuggagugcagaggaccuuagaacucaagugcaccagaagcuucaagaguuuagcggcgagugagcucuucuccccaccaaacgaaauucuaugcacaauauguaacacauauggaugcaguauaauaccaaaaaugcaguucuauauucauacaguauuuauuaaaugcuuacuagugacuggguacugguucuaggaguugguaguauagucccugcucucaggaaacucacauuuuaguggauuuuuuaaucaaacucagcauccagaaaauucaaccuaaacagggcuacaucccaaaaccugcacuggaagucccugaucuaguccaguccuccuauuuuccugaugugaaaaccgaggcccagaaagguuaggugauuuggcucaaggacaaaucuagugacaaccaucaguggagcaucaaaaaacacaucagugcaaacaacucagcagucuggaaaaggaaggagcuaguaacucauccucuggguuccacacuucuguaucuacugugcaauauacuaacagacacuugagacaacuaaaggaagucaucguuaguagcuuuaaaaaacgcucugcuccaucucaaaaacaaacaaacaaacaaaugcucugcugauccuaggaagaaggcaguuucaagugucucagagucuaauacauuuugaaagguuucccucaugacaguuaaaacgaaaagccagcaugugucgcauuaacccugggguggccacaaaaccgguguuccuggcugggcgcaguggcucacgccuguaaucccagcaguuugggaggccaaggugggcggaucaccugaggucggaaguucuagacgagccugaccaauaugaagaaaccccaucucuacuaaaaauacaaaauuagccaggcaugauggcacaugcccguaaucccagcuacaugagaggcugagguaggagaaucacuugaacccgggaggcagagguugcagugagccaagauugcauuauugcacuccagccugggcaacaagagugaaacuccaugguggcacgugccuguaaucccagcuacuugggaggcugaggcaggagaaucacuugaaccagggagucggagguugcagugagccgagaucacgccauugcacuccagccuggugacagagcaagacucugucucaaaaaaaaaaaaaaaagucuggugcucuugaacagcuacaggcugugcuaugguaaugcccacccccgacuaccucccuuccugcgcuucugagaagcugacagccccgacuaaaucaccccacgugcagauucaaccacuggccgcucuccccacaaaccacaucacagaaagggcucacugcucaaaagaacaccucugacccauuccacugcccaguaacaauauguuucucuuucaaggugguuagucuagcaacaagggcucugaacaaggaaaaacuugcacgcuucaccuacccuagaucccauaaaauccuguucuuuaggauucaguguccaauaaaagaugauuauuucaagucuuucuaauauuuuucacauaaauacauaaauuagaaaacaaaaugucagacaacaggccucugguuuggaaaaccacagcuguaccuggauaguaccagugcucagaggcaagaucaggggaaggggaaagggaggcaugggcccacacuaaccucucaagacgcaugucccuccuacagggucgcccucacuccucuagcccaccccauguucuggaugccugguagugccaugaaaguccugguuuaacagcuuuuuucuuggaguaacagcugcacuguuuuccuacagcugagaaaacacuuuuucucacaguuaacuuuagccuucaucaucccucaaacuucaggaaaccuucuuuccagcucuucccucuuuucacccuugaaauucaucuucuucuuccacuucuagcuugaaguggaaggaacgaauaggugugugccuuucccccaaacaaauagccgcuguucauugccuuuucaagcaagcacugccagaugcccaguggguuuuaucagcaccccuccacccacuucuggagcagguccucauuccaaggcaagcuggcacaaagcccuagacagccuuugugaggaugccugcauucaagcaccagcugccucgauggcaccaacuggcagagaacugucaugcaauuaccccuucgcccccagcuugagaaacuccuguuuauguucuuaaaauacauuugcaaaaggaaccagggccaaaugaaggugcuuauacuuauuucuucuaucaucaacagaaaugaaaauaaccuuacaucaccacccgccaaccuuuaccuuuuuguuuuuuuucauucaggguauuggcuacacacaaccaaguacgggaguacagagauagaagcaagucacaggccaggcgcgguggcucacgccuguaaucccagcacuuuggaggccgaggcagguggaucaccugaggucaggaguucaagaccagccuggccaacauggccaaaccccgccucuacuaaaaauacaaaaaacuagcuggguaugguggcacaugccuguaaucccagcuacucaggagagcaaggcaggagaaucgcuuuaacucagaggcggagguugcagugagcccagacagcgccaccauacuccagccugggcgacagagcaagacucugucucaauaaauaaaaauaaaaaaaaaaaagagagagagagauagaaacaaguaacuugcucauauuggcagcgguguucccucuacuuuuuaaaauuacaaggcagaagucuucuaucagcccuagauugugaagacuagcacuccggcaacaaaaucauacacaauggaccucaaugccaggcugacugaaugaauuguuauugggcugcaaaguaaacaggccaaagggguaggcuguucaggaaacagaucuuaauuacuguuauuuguucagucaaaccuagcauuuauuucuccagucagcuggguggaguggauguuggacugggcaaagaaggcuccuuugaagauucuggaucuuucucaccccuccuuccuuccccugcaaggaaauccaaggccucaacacucagggagccccaaguggagagcuaguuuggggccaggacacaccugauugaugccgccucugagguaggcgccucugagucacugcccuccauggagagaaaggaaucugagggcuccagacaggaaacugaggggugaaguggggaggggggcaaucaaguaguaacuggaaaaaaaaggacucugaugugguggugggagugguggugguaggaggguggccuggggagauggaggagccugcuggagugacaggaacagagguuugggaggagcguggauguaugcaugagacagcagggaagaaauggggucuugagcagcguggaugagggaaaagagccaggaaguggaggaagccccccaagaguggaggaagccccccaaaacaggucagcccugagcagaacaaaagcagagacugccucacugcaagagcagagagcacucggccaugcuagaggaccuuggcucaaugguacuccaaagggggcucaugaacagcugccugggcaucacggggagucucagccuccaucccagaucugcugaagcagaacuggagccugcaggguaaaaauaaauaaauaaauaaauaaauaaaccuucccaggggaucaucugacaucagccgacagcaggcacauuuaacaauccugcgcaccuuuaauaauccuguguucaagugaugacaacacgccacacacccaacagccagcugcccucgcucuucauucagaaggguccuuuggugauggcaaauaacaaaagcaaguuucccgugcgaucacacacgacuucaauauaacagauaagggaaucaugagagacuagcaugcagucucugaaaaagguaucuguaauucaaccuggaaaaaaugcuaauggacacauccuuaggagagaugaauacacaaaaauauuaaccaggauuaugggauguuagauggccuuuguuuacuuuaucuugucuauguuuucaagguuuaacauuaagcacgaauuucauaaguuuuuuaaaugaagagaaaacugcaauauuuuaauagguaaagaaucaaagaguagaaaaaaaguaaaaagccuauuuaauuugcuacccaccauauaggauauguuuuguugucuguaaaaugcacuccauuggucuacauuaaaaagcaagacaacuuuagcaaaaaaaaaaaaaaucaaugaacaucaaaagaaaauaaauacuauaaaaugaguuuugaggauaccuuuaauggccagacacggugguucacgccuauaaucccagcacuuagggaggccaaggugggagggucucuugagcccaggaguucaagaccacccuggguuguggggagacaucagcucuacaaaaaaauuuucuuaauuagcuaggcgugguggugcccaucugcagucccagcuacuugagaggccgaggcaaggagaaucacuuaaacgcaggagguggagguugcagugaggugugaucgcaccaccacacuccagccugggugacaaagugagacuuugucucaaauaauaauaauaauagcuuuaauaaaaauggucccaagcucacucucuaggguaagcacuuuccagacacugaggaacaaacacagaggacgcaggggaaaaucugcuacgcuaugcucccugaagaagaaucacccccacuuugcaacuguggaugggccacuguuucaaagcaauuucucaguggcgggacaaagcuuugcugaaucauuaucuccuguuauuaccucacaucaucacggacaaguuaggugucuacaaggagacucgagaaaugugauaugguggccucugaaacagagauuuacuucauaauaacaaaacuggaccacgugggaaccaaauccaaaauugugaccucaccagauccaacccagaaguuuugguggguuuuuugugggugagugugugagugugugaguguguguguguguguguuugagacggaguuucgcucuuguuguccaggcuggagugcaauggagcgaucucggcucacugcaaccucuggcuccuggguucaagcaauucuccugccucagccucccaaguggcugggauuacaggugccugccaccacaccuggcuaauuuuuuguauuuuuaguagagaugggauuucaccaugcuguccaggcuggucucgaacuccuggccucaggugauccacccgccucggccucccaaagugcugggauuacaggugugggccaccauaccggccaguuuuuuagacagucucacucuguugcccaggcuggaguacagugguacggucacagcuuacugcagccucgaccuccugggcucaugugauccuuccauuuuggccucccaacuggcuggaacuacugugccagaaugccuggcuaauuuuuuuuauuuuuuuauagagaugaggucucacuauguugcccaggcuggucuugaacuccuggacucaggcaauccaccagcaucagccuucccaggugcugggauuacaggcaugagccgcugugcccagccuagcuugccuuuucauaaacaaauaugccugggauuuuauaaggcauauagcuaucccucaguaucugcgagggacugguuccaggaccccucgcgugaauaucaaaauucucauaugcucaagucccugauauaaaauggaauuugcauauaaucuaugcauauccuccuauauacuuuaaauuaucucuagauuacucauaauaccugauacaauguaaaugccauguaaauuuguugugcuauauuuuuuaauuuguauuauuuuuauuguuuuguuuuuuuccccaaauauuuuugauccaugguuuguucaauccagacacagaauccacggauacagagggcugacuauauauaucaucauauucuuuuauaaaauuauaacugguuaguaucacuaacuuucucaugguauacaguaaggauaggcuauucaugcuuucuaaagaauaucccacccugagagcaaguucgagggucaaaguucuaauuaaauuaaaauaaaaugcaaucauacagacuaaauuccuaguacccuacgcauccagaaugauuugaaagaaugcauuccugagcuuggcaggguggguagcucucaccauagccaggaauagaugaaaaccucaagauuuaaucugugaugauacaacuaucuacucaucaacgagaaaguuagaaaagucaagccgggcgcgguggcucacgccuauaaucccagcacuuugggaggccgaggcaggcagaucaccugaggucaugaguucaagaccagccuggccaacauggugaaaccccgucucagauaaaaauacaaaaaaaaaaaauuaacugggcgugguggcgggcgccuguaauccuagcuacuugggaggcugaggcaggagaaucgcuugaaccugggaggcagagguugcagugaguggagauccugucauugcacuccagccugggcgacaagaacaaaacuccgucucaaaaaaaaaaaaaaaagaaaaaagaaaaagaaaagucagaaaugaaucugggcacaguggcuuaucccuguaaucccagcacuuugggaggcugaggcgagcagauggcuugaguccaggaguuugagaccacaggaguucaagaccacccugggcaaaguggcaaaaccccaccccuacaaaaaauacaaaaauuagccaggcuugguggcacacgacuauagucccagcuucucaggaggcugaagugagaggaucccuugagcccaggaggucgaggcugcaaugagcagauacugcaccacugcacuccagccugggugacagagcaagacccugucucaaaagaaaaaaaaacagucauguuugaugagccaccauguuagccaacauccaguccuuccaaagaagggagaaauuggggaagaaaagagaaaauaggcagcagaaacaauaguaacagaagcaacagcucuugaaaaguguauaaaaacacaacuuuuuuuuuuaaagacggaauuucccucuuguugcccaggcuggaaugcgauggugugaucucggcucacugcaaccuccaucuccuggguuuaagugauucuccugccucagccucccgaguagcugggauuacaggaaugcaccaccacgucuagcuaauuuuguauuuuuaguagagacgggguuucaccauguuggucgggcuggucucaaccuccugaccucgugauccaccugccuuggccucccaaagugcuggaauuacaggcgugagccaucacgcccagcguuuuuuuuuuuguuuuuuuuuguuuuuuuuuuuuuuagacaaguuuugcucuuguugcccaggcuggagugcaauggcgugaucuuggcuuacugcaaccucugccucccagguucaagcaauucucuugacucagccucccgaguagcugagauuacaggggcacgccaccacacccagcuaacauuuguauuuuuaguagagacuggguuucaccauguugcccagucuggucucaaacuccugacuaacccaaacacaacuuuuugaguaccuguuaugugcaacauauacuucacuagauucuuuacauaaguuacagaauuuaauguuuaucacagcccuaugcuguuaucauccaccucuauuauaaugagaaaguggaucaaauaacacagacaaaccuauuaaauagaacuggaauuucugccucagucaggugacuccuaaguccauuuguuugcaauacuuuauaauguuuaaugauugguguaacaccuugaucacaccuucacaaccuuccucucauucuaucuuuauaaccauuccacaaggcaggcagggagaguagcaucauucccaacauagagacaaaugugaagccugaauaaguuaccuuauuuuuggaacucauucuccuucuuccugauagcacccugcuggaugagugcaaugagcagcaaagccuugauggugcugacagaggagaccagcaacacccgaaaagacaaagacagcagcuuugcuacuuccauacugccuuaaaagaguaggguuaucccaugcaccuguguaauaugcacucacacaugcacacgaguguguacgcaagggcagagaacaaagcccuaaagacggaacaaagccccacagcccuaguucuauuucuaaaugucaaacuuugcagcacguucaacaauuuaaggaggcagagaauuauauccugugcuuccaucgaaacaccaaaauuaaagaugugagugucuuugguaaccaaggagauccuucuacccagcacucauuauaaguaauaguuaccuaucauuucuuaaguacuuccuauguaucaagguacuacucuaaggugcuuucaagaccuuucauuuaaucuccccaaaggaaaaaaaaaaaccaccccccugccuuuuguuugagacagugucucacucuguccccccagguuggagugcgguagcacgaucucagcucacugcaaccuccaacucccacuucaagcgauucucgugccucagacucccaaguagcuggaguacaggugcacacuaugaugccuggcuaauuuuuuguauuuuuuaguagagacgggguuuugccauguuacaggcaugagccacugcauccggccaaaaauaacccuuugauagaaguaucacaaucuccauuugacagaugaggaaaucugagucucagagguuaaccgacuuuccagaagccacuuugggauaaaccaaaauccugaucucugauuccagagcccaacaggauuccaaaaccaguuuuccuucaccagaucucaggauaucuggaauauacuguuuugaccccuccuccaccuacuccccuauagaaacauaaaaucaagagagacccuaaaacaggugcaugcaccuacagcagucagaagagcccacuggaugcugccccuugugagggcuaguccugaccuugagaugugccauucccaaugcuuucugcgagaacacagcacagccuugggcaucccaccaccguuccgaaagccauucuucauucuucuuguaauuuguggcagugauacuaauaauaauuuuuuuaaauaauaggaaauugcauugugcauuuucuaggugccagguaggguccucaguucuuagcauggauuuacuucauccucacaauaaucccaugaaguaaauacucauauugccauuuuucacaaguaagaggauuauaauuuaaauuuuuggcauaauaugcccuacuuuuuuugagauggagucuggcucuguugcccagagcuggagugcaguggcaugaucucaguucacugcaaccuccaccucccggguucaaacaauucuccugucucagcauccugaguagcugggauuauaggugccccccaccacgcccggcuaauuuuuguauuuuuuguagggacaagguuucaccauguuggccaggcuggucuugaacuccugaccuaaggugauccacccaccucagccucccaaagugcugggauuacaggcaugagccacugcgccuggccuaugcccuacuuuuauaaucagaaaaaauuuuauaagcuauacugacugaaaaaugaggaaaagacaaaauaaguagagaaaacauaaaggaagaaaagagagaaaaaggaaaaacgaauuccauuuuuuucacaaaugagaaaacugaggucucuccuaaggucgagauaggaacucagucagccaggcccuaaacucuuuccugugcugcuauggugccgucucuagagcagagcugucucuagagagucacagcacaccucauaauaaaacuguguuuacagccgggagcagcggcucacaccucuaauccuagcucuuugggagacccaggcggguggaucacuugaagccaggaguuugagaccagccuggacaacauggugaaaccccgucucuacuaaaaauacaaaaaaaaaaaaagaaucgcauguguagauguuuauuuuuaaauugacuaccugauuuuugcagucaaucauuugaaaguuaaaaauucaaaaacuagccagggugggggcgaacaccugcggucccagcuacucaggaggcugaggcaugagaaucgcuugaacccggaaagcagagguugcagugagccaagauagugccacugcacuccaaccuggacgacagagugagacccugacuuacaaaaaagaaaaaaccuguguuuacacaagguaagaagguuuaaaaguuucuagcaauuauucuggacuuugguuaaaaguacagacacuuggccugcaugguggcucacaucuguaaucccagcacuuugagaggccaagguggguggaucacuugagcccaagaauucgagaccagccugggcaacauggcaaaaccccaucucuacaaauaauaugaaaaaaaaaaaaaauuagccaggcaugguagcaugcaccuguagucucagcugcccaggagacugagaugggaggaucaccagagccugugaggucaagaaggcuacagugagcuaugauuucggcacuacacuccagccugggcagcagagugagugagggagggagggagggagggaaaggagggagggaaggaaaggagggagggagggagggagggaaaggagggagggagggagggggagaggaggaaggaaggaaggaaagaaaaaauguauagacacucagcauaaaacagagugaaaacugaguuuggcacuuguaguauguauaaaauuugaaucacaauccaaaucuuucaucauugccuuucucuuucaacuauuaagaauuuuuuuuuuguuuaagaaagggucucauucuguugcccacacuggagcgcagugguccaaccauagcucuuuggagccuugaacuccuugccucaaaugauccuccugccucagccucgcaaguacuuaggacuacaggcacaugccaccaugcccugcuaguuuuuuuauuuuauuuuuuguuugcuauacuccccaggcuggucuuaaacucccagccucaaucccaaagcacuaggauuacagacaugaaccaccaugcccagccaggacaaaaauuuuaaguugccuaaauucucauucacuaucauucugcacaaaauguccuugucuaaaauuucccacauaauucaugguuuuuucuuguugauagcauuagaauaccucacacucuaauauaaauaaaaagaucauuccaaacucuucaaaguuaacuaugacaagaaacaagaacaaaagaaaaagguggaaaacaaaaacuauacuuaggcuuacaacaaauuuagugauaaauucagagaauuucuuuuuucucaaaauaccaccaauguuuuacauaccuuuuuuuuuuuuuuuuuuuuuuuuuuuuuggggauggaguugccuaggcuggagugcaguggugcgaucucggcucacuguaaccuccaccuccugaguucaagcgauucuugugccucagccuccccaguagcuaggauuacaggcgcaugccaccacgcccggcuaauuuuuguauuuuuaguagagaugggguuucaccauguuggccaggcuggucucuaacugcugaccucaagugauccaccugccuuggucucccaaagugcugggaucacaggggugagccaccauuccuggcauuuuacauacuuacacaauuuuuuuuuuuuuuuuuuuugcuaauuuaacaucucagaauccucuuuucagagacugcaaaaaacaaaauaguuuugcaaccaaccuuuaaaguuauugaguaacuaaaagugaucaauauaaacaaacuagaauuugaacucaccuacauugaacauucauuguuuaagucaacacuaggaaaggguaaaaguaaacaacaaaaaauugcuccuuaauguagggagaaaucucuuggccagugaagcaauacaaaaacacagacauucugcuuacaggaacuaauuaaaaagaaaaggaaaaaacaaaacacagaccuguucagccauauaaaguuauaaugaugaacaucuguaaagauuacaugaaaucacccauguaaagugcucagcacaugugccugguccguaaguguuuaauguuagcuugcaugcaugcucauuucauucaauacaaggcuacuuaaaugcucugugccucugcugccucauacaaaacagagacaacaguaguuccuacaucauaggauuauuaggacugagaauguuuucaaggcacuuagaacguuaauugucaauauuauucucagugugcucgaaaaggaaggccagagguuuacagggcugggaucuaaaccuagucacuccaaagcacuagcaucucauuuccucaaacucugggagauuuaccuaguugccagcucuccucccacugcucaggaaauucccagggcagaaggaacccaaggacucgcucccucuuggaggcucagccugcuccaggagcuugcagcucuagcauccccaaccccaucacccaaaccucacaccugaccaaaaaccuauuggccaggcacggugguucauaccugcaaucccagcacuuugggaggcugaggcaggcagaucacuugaagucaggaguucaagaccagccuggccaacauggugaaacccugacucuacuaaaaauacagcaaaaugaagugugguggcaugcaccagcuacucaggaggcugagauaggagaaccauuugaacccaggagggugagguugcagugagccaggaucccgccacugcauucuagagcaagacugucacaaaaaaaaaaaaaaaaagaaaccauugcucuucaaauuuguuugccaacuacugauuucucuuuucaaacggggcuugagggaaguuuuauaaccauguaaaacaaauaauaaugcaacaacagccgccacucucauuuaugcagcacucccuuacaagugccgucacagacucugugacaccagcacaaucucucccaaccugucagguauuacuguuauuauuauuuuucuccucuguaccaguugggaaacuuggacucuaggaaauaaauugcccaaggucacagcuccuuuguggugagcacaggguccaaacccagguauaauuucucucuuucuuucuuucuuucucucucucucucuuuccuuucuuucucucuuucuuucugacaguauucuaucccaggcuggauggagugcaguggcacgaucacagcucacugcagccucaaccuccugggcucaagcaauccuuccuccucagccucccgaguagcuggaacuacaggcgcacacuaccaaccuggcuaauauuuguauuuuuuguagagacuggguuuugcccggcuggucucgaacuccuggcuucaagcaguccuccuaccucagccucucacauggugggauuacaggugugagccacugcaacagccccagguaguuucaaagccaguauucuuaacuaccucaccaaagugaauguggaaaagagaaaaagggaauaguacuuuuaaaaaacaguuaacuauagaaaacccaaucaaaauucauuuuccaauuaaguuauugcuuaguaaaugaaaauauuaaauaaagaaccggcuacugcuccacauggcaaggaaguguacuucagugcugacaaccccauuacucaggagaacaguuuaacugugauauauggauggcuccagugaccacugccacuguauuuauaguuugugaucuguauaaacaaaaucauuucucaugccuguaacagcaucuacugcaggccuuuguuacuuacaauuaaaucucuauaaauguuuaaaucucauggucacaaaaaaaaugagucagccaucuaagaaugacuggucaccaguucccaaaacacaaccuccagcgucaugaccaccagccccaguaggucuaaauuccagaugaauaauucuuccaacguacagucaaauuaaaaaaaaaaaaaaucaauagaaucgagaacccagaaauaaagcuuaacacugacagucaacuaauucugccaagauaauucaacugggaaagaauagucuuuucaacaaauguugguggaacuggauauucaaaugcaaaacaaugaaguuggacccuuuccccauaccagacaaaaauuaacucauuaagaauggccaggugcaguggcucaugccaguaaucccagcacuuugggaggccaagaagggaggauuaccugagcccaagaguuggagaccagccugggcaacauagugagaucccaucucuauaaaauaccaaaaaaguuagccaagcaugauggcaugcuccuguggucccagcuacaugagaggcugaggcaggaggaucacuucagccugaggguucagggcuguagugagccacgacugugccaccacacuccacccugagaaacagaccaagauucugucuuaaaaaaaaaaaaaaaaaaaaaggccgggcaagguggcucacgccuguaaucccagcauuuugggaggccaaggcgggcagaucacgaggucaggagaucaagaccauccuggcuaacaccguaaaacccugucucuacuaaaaauacaaaaaaaaagccgggcgugguggcaggccccuguagucccagcuacucgggaggcugaggcaggagaauggcaagaacccgggauguggagcuugcagugagcugagaucacaccacugcacuccagccugggcgacagagugagacucugucucaaagaaaaaaaaaaaaaaaguggaaacaacccaaaugaucaucagcaaggaauggguuucaguaaagugugguauauuccaguaaaaggaaugaaguacuggccaggcacaguggcucacgccuguaaucccagcacuuugggaggccaaggcggguggaucaugaggucaggaguucaagaccagccuggccaacauagugaagccccaucucuacuaaaacuaugaaaauuagcugggcauaguggcacacaccuauauucccaaauacugaggagguugaggcaggagaaucacuugaacccaggaggcagagguugugcugagccaagaucacgccacugcacuccagccuggugacagagcgaaacuccaucucaaaaaaaaaaaauaaaaaggaaugaaguacugacacgugcuacaacauggaugaaccuugagaacauacuaaguuaaagaaguaguccuaaagacuguacauuauaugguuucauuaauaggaaacgucuacaaaagcccauagagacagcaaguagauuaacaauugccagggcucugagggaguuugggagggaacugggagugacugcuaauaagcauagaggugacaaaaacuaaguugucaugaugguuccacaacucuguaaauauacuauaaaaccacugaauugcacacuuuaaaugacugggcuguauaugcuaugugaaacuacuuuuuacuuuagcaauaauuucuuuaaggccgggugcaguggcucacgccuguaaucccagcacuuugggaggccaaggagggcggaucaucugaggucgagaguucgagaccagccugaccaauauggagaaacccuaucucuacuaaaaauacaaaagauuagcagggcaugguggugcaugccuguaaucccagcuacucaggaggcugagacaggagaaucacuugaacccgggaggcggagguugcggugagcugagaucgcaccauugcacuccagccugggcaacaagagcaaaacuccaucucaaaaaaacaauaauaauuucuuuaguuaaaaauaaccuaauagccauuuuaggauaaguuuaaaaaaaacucaauaauucuaaaaucacuugguuggacaucucugcucauuagagaagugcaaguguggacaucucuccaaugccacuuuaagaauaaaaauaaaacuaggacuuuuuuuuugaacacuuguuaauuuaaauaggaaguauccuauaaauaaauaggaaguauccuauaaauaaaaaguauccccaaaagcaaauuccuaggacuuuaggagcugaaauugcuucauauguuucuuaaguuauuagucugcuguaaaaugcuuuguaaaguuuacaggaaguauuuuauagaucuuucaacuuuuacuuuuuuuuuuuuuuuuuuuuuuuugagacagagucucacucugucgcccaggcuggugugcagcggcaugaucucggcucacuacaaccucugccucccggguucaagugauucuucugccucagccuccugaguagcugggacuacaggugcccgccaccaugcccagcuaauuuuuguauuuuuaguagagacaggguuucaccauauuggccaggcuggucucaaacuccugaacucgugauccguccgucucagccucccaaagugcugggauuacaggcgugagccaccaugcccgaccccaacuuuuacuuuuaagagacugcacauuugaaauggcugaaucuuagcaccagagcagucauuucuccagcaauuuucuugucuuguaccaaagcagcccuuugaauaauacuuccuaauaauccacagccagcuggagcacuugacaaagacugaucugacaguuuaaucuuagcaccauuguuuuaggauuggcguacccguuuuuuccaguuccauucaccucacuacacuuaagaaaaaucuacauuuacauauguaaauuguagacaauguugauaaaaauaaauuacaccacauauucauaccaguugugcaaccaaauugauguuuccuuucuaaugcaaaaauguguuaaacucuguuaucuccaaacccacuucuaaacacaucacacacuaccaccacucccaccacaaagggcagggaugauaucaaaaugaaaacagugcuagcaaauacaauuauaaaacaugaugaauuucgcacauuuagguuugcuaaaauaagcuuuaaaguuguugaaugaaaaacaaaugcccccaacguuauccccuacccuccaaccuccuauuauuacucuauugcuguaaccaccgguggcaguuucuaggauaucuuuaaaacucucagaauuauugcauauauauguaccuacauacauggauacauacaugccuuucaaauuggaaaccauaauuggguucaucauagacacaguguucuuuaaccuccucuuuuuauaaccccuacuuaacuaacacuguuaucuuggcuaccuguuccucacagauuuaacuuacucuuuuuuuuuacuaugcugaaacacacauaacauuaaacuuaucauccuaaccacuuuuaaguguacaguucaguaguguuaaguauauucauauuguuguccaacagauuucuauaacuuuuucaucacgcagcacugaaucgcuauacccacuaaacacaaguucucccuccuaccuccucugggcccuugggaaccaccuuucuacuuucuaugauuuugacuacuuuagacacuucauaugaguggaaucauacaguauuuguccuuuugugacuuuuauuguauacuuuuauuucacuuagcauaauguccuugaggugcaaccacguuguaguaugugacaaguuuuccuucuuuauuaaggcuguauaauauuccauuguuaauuucauucuuuuuaacggcaacauauuucauuguaugaaaggcuaguaacuuuuuauuucaaauuagucuucauuaucaguguuuaagauguuccaaguuuacuucuaauacaagaaauagaagaacugcuagacccaagaacauauuuaauuaugauucagacauuaugacaaaauaaauucuccauaagugaacaaacacaaaucaagaagaguagguuuuucuuucaccuuucuuuuuaacuuugccaaugaaaacucucucauuuuuaaugguaauuuuuuuguuguuuuuuguuuguuuguuuuugagacaagucuugcucugucgcccaggcuggagugcaguggcaugaucuuggcucacugcaaccucucccucuuggguucaagcaauucucgugccucagccucccaaguagcugggauuacaggcaugagccaccgcgccuggcugaauuguaguucuuaaauuauaaguaagauugagcauuuucucacauuuguuggcauuugcauuuuuuccuaaaugaucccuaaccuuuuaaauuuuucuguuauguguacuuucuguugauuuauaagaacacugugcaaauuaaggcaaguggaucccuguucuacgaauaacugugugucaugcuuagaaaaaucuuggccauuuuagauuauuuuaaaaguucacccaucuuuucucaauacuuuuaauggacuccuuuuuaacccauuuuaucacgguuaaauacuggaucuacacauuacuuauuuuaauggaaaggguguggagcaaacuucaaagaaagccuacugacaacuuacaauuuggauaucaguaucccaagggagagugacgguccuccccaaaacuacaacaucuaacauuuaugaacucauacugugggccagccacuguuccaagcgcaaaauccuauaaaagagauccuagggauuaucccauuuuacagauguacaaacuaaacaacagacagaugaaguaacugaucaagggcacaccaccaguaaauggcugagaacauaccggaacucaggcuuccuaucauuagaacuggcucuuaacuucucagcuacaccgccucugaacuauaugcacaaaaaagccuaaaaaauccacaccaaaaauauguuuaaauuaauucucaguagaaagcagguuuguccuuuuccucccaucaaauacuucaaguagcuuaaguccuaaaucuuuuuuuuuuuuuuuucuugagacagauucucgcucuguuguccaggcuagagugccauggcagcucggcucacugcaaccuccaccuccuggguucaagcaauucuccugccucagucucccaaguagcugggauuacaggugcacgccaccacgcccagcuaauuuuuguauuuucaguagaggcggggguuucaccauguugcccagguuggucucgaacuccugaccucaggugauccacccgccuccgccucucaaagugcugggauuacaggcaugagccaccgcaccuggcccaguguuucuuuuuucuuuucuuuucuuuuuuuauuuuuuugagacaaggucuugcucuguugcccaggcuggagugcaauggugcauugucaucucacugaaaccuccauuucccagguucaagcgauucuccugcuucaaccucccgccaucaugccgggcuaacuuuuuuguauuuuguagagacgggguuucaccacguuggccaggccggucuuugaauuucugaccucaggugauccacccgccucggccucccaaagugcugggauuacaggcaugagccacugcgcccggccccaguguuucuuuucugggcaguaucacugccugccccaggggucaggugcauccuugguaguaaaggcaggggcaguguuuucacaaagacuggugagugcuauuggcaucuggggguaaguuaaauaucagcuuugcacaggacucucuaauuguuuuacaaacaucaaaaaaggagaaugaaaugcuaagaagagaagaagagggcuuucucucucuuuuuuuuucaugucuuuugucaugucacccaggcuggguugcagugguacaaucauggcucacugcagcuucaacuucccagccucaggugauccucccaccucagccuacagaguagcuagcacuacaagugcacgccaccacgcccaucuaauguuuguauuuuuuuguagagaugggguuucacuauguugcccaggcugguaucgaauucuugggcucaaguaauccgcccaccucggccucccaaaguacugggauuacaagcaagagccaccuccccaccaguugccaguucucucuaauaaucagagaauacccucaagcaauccauaaugaaaggcaaaugaaaugagcauugguguuccucucaagcccuggguccagcuaucugccacaccccucugcaagaaaaaaaaaaagaagucagagacucagcccugcuggaacucuugcuuccaaaaaauaugcaaucggccaggcacgguggcucacgccuguaaucccagcacuuuggggaggccaaggcggguggaucacgaggucaagagaucgagaccauccuggccaacauggugaaaccccaucucuacuaaaaauacaaaaaauuagcugggcgugguggcgcgcgccuguagucccagcugcucaggaggcugagguaggagacucacuugaacccgggaggcagagauugcagugagcagagaucgcaccacugcacuccagccugggcgacagaguaagacucugucucaaaaaaaaaaaaaaaaaaagaaaagaaaaaagaaaaauugcaaucccguggcaacccucauuccuccccgccccccaucauaaggaaauaauuuacagcuucaugcuuuucaaagccuccagccagaagccgcugcuaggcaaaaugauuugcauaaagugccucauuuaaauggcuucauaccccuuacucagcaaccugcaacuuccgccaacuacacuaacggugagauaguacacucuuagaaaccgcuuucuguuaaauucuaucauccacgcauagagcagaacuuucuggaaaauaacuuaaacaacugcuugagaguuuaagagaaggaagggaacaaaaaguuuaaacagauuuuauuacaacaaaauacaguauaaaaccccaauccagagccaggcaugguggcgcaugccuguaaucccagcauuugggaggcugaugcagguggauugccugaggucaggaguuccagaccagccugaccaacguggcaaaacccgaucucuacuaaaauacaaaaauuugcugggcgugauggcaggcaccuguaaucccacuacuugggaggcugaggcaggagaauagcuugaacccuggagacagaggguagagguugcagugaacugagauccugccacuacacuccagccugagccacagagcaagacuucaucucaaaaaaaaaaaaaaaaaaaacccaauccgagauucaaauaaucaaaucauaagacuguguuuaaaauccauagcuaugagcucuuuguugaacugcucugcacagacagcagauuaucuuugggaaaagcccaacauccacucauucacgcucucgucauuuaccaaaggccaaguguguacugggcauuggaaaauagcaaaggcuaggagagcacagggguaguaccugcugugagcugacuagcuguguggccuuggaagauacccugugcuccaggaccuguuuccugaaaaaaacuuauuagguggauaugccacugccuuaaggauccuucuagcuccagaauuagacugugacuucccagauucucacaaccccauggacagcccauaagccaucugagaauggcaacgcaggacccggagcaacgggcauuacgcccaucagaaaccucaucagcagcugugagacuuucucuggcuggcugccaaccaaagacuucccacaaugguucuaauuucaaacugccugaccauuauccuuaaaaacuauuggagugugcuaaaaggucugauauuuuggcuucuuagugaaauuucucauacccagaggcacaaucccccuugucagcaugcccccaauuuucaguuuaugguuugggugaacacugggauucuuuuuuuuuuuuuuuuucaugucacauggguaauguaccaacgacaugacaagauuuaagggaggcacaucucacagacaagcaugaaaacccaaucaucaugcuuaugaacuaaaaaggaaacuggauucuuacaaucagaaacaggaauaucaaccaaauugugguacccuaugagccaggagccacagaccaugcccaccuuccacuccgccucuuuuaacuuuauuauacaaaaauagcuguaucccuccccaggauacaggcaagucacuacagccuugagaagccagcaggaagaagaauuaaaccagaucucccuaagggugaaguagagcugccuucaaagauaggaaguuccugccucuggaguuguuuguuuauuaugguacaagaaaucgagcacaauugggucagaagaacagaagacccuuccagcgccaauuuucugggaggugguccaaaggaagucaguggggccagcucucucccucagacagcuaacaggagcaaggcuuggucagccuuccugaagcucugcaaguccaaggcuucugagcuauuuauucuauacuuacuuugaaaacacaaaauugcuccaacaggauggauauguuacggaacaauuaggcauaauaggaugugcauuucugucuacugagaaacaccagguagaaaacugcaccaagcugaauugagcuucgugguaauacacaaaaaaugcacacagcucagcucaacaagugcacugagucacaccaaacacauuugauguuacaacuuuccauccaauuccagauaaccuuccucccacugcuucucaacugcucaaaagccuaacucuccaaacccauuuccacaagguaauuugaagacuuuuucaaauaaaaugccaaauuuaccauaguaguuauguauuucuuaaccauuuaacauuuauaaaacuauaucauuuuuauucaguuccuuuuuucagaugugucacugacaaaguuuuagaauauugugcccuuaaccaaauuuuccccgugagaccugugguuucauugugcaguucugcuuaaugugguaauuuuuagaaugcguaugucauguuguauuguagcagaacuauuuccagggcucuaguguagaguauuuacauucauucuuaaaaauuacacuaaauguccaaaaggaaaauaaaauaaacauuuguaugauuaauuaaaucauauaaacagguaucccucugcugcccaggcuggagugcaauggcaagaucauggcucacugcagucucgaccuccucagccuggcucaagugauccucccaccucaucccccugccgagcagccgggacuacaggugcaugccaccaugccugaauaauuuuuugauauuuuguagagaugaguucucacuauuuugcccaggcuagucuugaacuccugggcucaagugauccgcccaccucaguccccaaaaagugcugggauuauaggcaugagccacugugcucggccguguauuucuguaaagcauaaaauauuguuuuuaaguuaguuuucauaucauguuacuuaauucaucauuucaagauuaaaucaguaucuaguaaauugaucugccuaccuagcgauugguuuccaucacuaaugauaaaaguuuugaugcuucucccuuuuucaaggugcuacauacuauaauccuuagaacaucuuaagaaauaaaaaggcaaggcugggcacaguggcucacaccuguaaucucagcacuuugggaggccaaggugggcggaucacgaggucaggagaucgagaccauccuggccaacacaaugaaaccccaucucuacuaaaaauacaaaaauuagccaggcaugguggcacgugccuguaaucccagcuacucgggaggcugaggcaggagaauugccugaacccaggagucggagguugcagugagccaaaaucgcgccacugcacuucaaccuggugacagagcaagacuccgucucaaauaauaauaagaagaagaaauaaaaaggcauauaaacacagugaaaaauauucaauuagcccucuccucaaaaaaagauaagaacaaagaacagaagaggaaaugagccagguuucaguuacuugguaggcugaggcaggaggaucaccugagcaaaggaguuugaggcugcagugagcuaugauugcaccucugcaccccagccugggugacagggugagaacccaucgcuaaaaaauaauuaauaggaauaaaaaaaagaaggggaaaugaaauggaaacugaucaacaauuuauagccuuaaacucaaacauaugaguaauuacauuaaauguaaaugauccaagcauccaauuaaaugacaaagauuggcuggguacaauggcucacacauguaaucccagcacuuugggaggccaaggcaggaggaucacuuggagcccaggaguuugagaccagccugggcaacauaguaagaccgugucuccacaaaagagaauuaaaaaaaaaaaaauccaugucaggugaugcauaucuguaguccuagcuccuugggaagcugagguaggaggaucacuugagcccagggcauugaagguauagugagcugugaacguaucacugcacuccagccugggcaauggaacaagaucccaucugaaaacacaacaaaacaaaaaaagugaaacaaaacaaaaaggcaaagauugucagauuggauuaaaaagcaagaaagacccaguucuaucacgucuauaaaaagcauacuuuuaaguauaaagacagauuaguugaaagccaaaagggugguauggcuauauuaguaucuaccaaauacuaaaaaaaagacccuuuuagaaaaauaggucaggugugguggcucacaccuguaaucccagcacuuugggaggccaagguggguggaucauuugaggucaggaguucgagaccagccuggucaacauggcgaaaucccauuuuuacuaaaaauacaaaaauuaggccaggcgcaguggcucacgccuauaaucccagcauuugggaggcgaggcggguggaucacgaggucaagaguuugagaccagccuggccaauauggugaaagcuugucucuacuaaaaauacaaaaauuagccaaguguaguggcaugcgccuguaguuccagcuacucgggaggcugaggcaggagaaucacuugaacccaggaggcggagguugcagugagccaagaucucaccacugcacuccaaccugggugacagagugagacuccaucuaaaaaaaauauauaacauaaaaaaaguaaccgggcguggugacacaugccuguaaucccagcuacuccagaggcugagacaugagaauugcuugaacuugggagacagugguugcagugagccaagaucaggccucugcauuccagccuaaaugacagagcaagacugcaucucaaaauguuacacauuguuacauuucuucccugcuauacaaaccucuaguuuuaguaggucagggagacagauuugacacugagcuccuaucucccuggcugcagcacccgauuaaagccuucuuccuuggcaauccuugucgaucucagucgugggcuuuuugugugcugagcagcaggaccuagagagaaccccuggucuuuaggcaacauucauaaguucaagagucccaggggguggccccuucauucuugcuccuuuaguucuacaauuauuuuuuaaacauaccuaauucccuauaguaaaucuucuucuuuuuaaaauaccuagagugauguuggcuuccuacacugaacccugacacacugcaucaccacuuuacagauaaaaaaagacucuuacauaaaacaucugauuugcaucccuucaacaaucacuaauauuguuaaaggggauuuuaucucuuuaacaacauuagggagacaagacaggaauuuccccuacuuaacaagaaaauuuaagaacuaggaacaguagugagcuccccagcacuggacagauucaaacacagaugcacacugaagaggggcauuaaaaaggacaucuaagcuucagaugggucauuaaaaaaaaacagaugccuuuuaagguaucuuccaagaguuucugugguuccauaaccugccucaaaaaucaagcaaggcugggcaugguggcucacaccuguaauucuaacacuuugagaggccaaggcaggaggauugcuuaagcccaggaguuugggaccagccugggcaacauagugagagccugucucuauuuaaauaaauaaauaaauaaauaaauaaauaaauaaauaaauaaaacaaaauaaaauaagcaagcagcaaaaccuggaucucuccagaaccagacuugccucuacagaauuuuucaaagaacugaaucccaguugaugagauuccacaaacuuucauagaaaaaguagacggugggggagcacagaaagugggggauuucucugaagaaaaaaggggauggagggcuacccuuggacucgauuuuggcagaacuuaaagaauaguuaaacuucagcauccugcaauuugggggcaggaagcuguuuuccuacuaccauccuuuuaggcccagcccagaccucuuuaggcucuuaaucugugcuuccuuuuaucuuaaaagauaauaaccuccccucccuggcuucaguuccucagcuccccagcauuucucuaccuucugcugccuggaaacugaggcugccaaaacccccaagcacuuuuuuuuuuuuuugagauggggucucguucugucacccaggcuggagugcaauggcacgaucucggcucacugcaaccucugccucucagguuuaagcgauucuccagccucaaccuccugaguagcugggauuacagaugucugccaccaggccuggcuaauuuuuguauuuuuaguagagaugggguuuuaccacguuggucaagcuggucucaaacuccugaccucaagugauacgcugccucagccccccaaagugcugggauuacagacaggagccaccacaccuggccuuacucuuuuuuuuauuuuuggaaacauggucucggccgggcacaguggcucacgucuguaaucccagcacuuugggaggcugaggcggguugaucaggaguucgagaucagccugaccaacaugaaggaaccccaucucuacuaaaaaauacaaaaauuagccgggccuaguggcaugcgcccguaaucccagcuacucgggaggcugaggcaggagaaacgcuugaacccagaaggcagagguugcagugagcugagaucgugccauugcacuccagccugggugacaaagcgagacuccgucucaaaaaaacaaaaacaaacaaaaaaagaaacauggucucacucugccgcccaagcuggagugucgcagaucaaaacucauccagccucgaccuccugggcucaagcgauccucccaccucagccuccagacaagccagcacucucaaaaaauccacaggcacugaucuucgaucuuccucucucacuugacuucaaguugucgucugaccaggccaguuggcuccacaccucuccccacccuccaggcaggcucuaccuucacuuaauuuccuuuauuucccuguuggcuacagggaaugugugccuuuugaauuggagauguuucucaagguuccaagguuaggcuuuccuucucguacuacagcuguuuuuuccugaggugagauuuccuugagaagcugagaaaugauggggacuuucuucuuggaaaaguguucaggacauaaacaacacaacugugugugcaacugcaggauugcauggaucucuagagcccauucaggaaagaggacccacucuccccgugcuccccugcaugggcucauccacuucugggggcaaaugucccugccaagggacccccagcuucuacuccuuuuccaaaagauaaaaggugcaaagcugaggcaaacaaacccucaauccagucugugaagaagcacuggcccaggcacagucucauaggcuagcaaauucagcaucuauucacaagucacucccaagcacaagcagggcuagcuacauacagccucugaacuucauuauucuaggcacccagugaauauuuauuuuuuuuuauuuuuuauuuuuugagacugagucucacucuguugcccaggcuggagugcaauggcaugaucucagcucacuacaaccucagccucccauguucaugcaauucucgugccucagccuccugaguaucugggauuacaggcaugugcuaucaugccuggcuaauuuuuguauuuuuaguagagacggggcuucaccauguuggccaggcugguguccaacuccugaccucaggugauccacccgccucagccccaaaaaaugcugggauuacaggugugagccaccacaccuggccccagagaauauuuaucaauugacauuuuacuuuagggauugucagcucuuuaaaaaaaaaaaaaaaaaaaaaagaguaacagcuaacaaaauaaguccaacaaaguccuagaguccuuagggauaaggcuagcaaagcuaaagaaaaauuaccacuauagaauccuauuagagcaaacaguuucauuacuauggaaacaaaauacugccauuguuucugagaauggcaguggaggagaucaaugagcauggaaucaagaacaaaagacugaauuccucccuaguuggggugaaccacacucaccaaggaucaaagcauuaggaaaucagcccuccauuaaauugcugagacauaaugugagugcaaaaacaaaacaaaacaaaacaaaaaaauggaaaaggcauuccacaaagaccucaugaauuuuguuucaaaaugcacuuagcuaguuuauaaaaaaaugauacuuaaacacaagucugauuuucccaucuucgcuaguuaucuuuucauaaauaagauuuaagggguuaugcauguguuuuuccuacuuuuguuuugacuacacaguuuucaugagagagugaaaaugcugucuaaucacuauauacuguaaccuuacuucaaaaacccacaaauuguuucaaaauuuacucucugauaaaaacccacuaagucuuuccacaacagcugcuuuccuuaaacaucagcaauuuuaaucucacaaggcaaacuacggaagaaaagccaaaaguaaaauccugcuucccuuuaaaauucaaacagauguucuguguaaucacaccaacucaguauuugaauuuccuacugcccuauacugacucucagauuaaguucuaaaauguuuugaaauaucauuaauauauaagcuagaagaauauggggauauucucacuguaaauguuuuaaaauacauuuuaagcagggcagcaaagguuuacucugggcuacuugggaugccuaauauuugggaacaaucacagugauuuagagagguaacuugauugauacuguucucaggauccaaucauaacccuaaauucaacugcaaacagcaauauguaaaauucaccaacaaugcggcuugacucagaacacuaagaaaacacugggucuuuacaauuaggcagguauggccacuuaaaguacuaaaaauagcuuggucaaagaauuacauccaauggcuaguucuguagacauaucagcuuauaugaagacuuccuuuuuaacaucaaguuaucacagaugaucuggccacauacugcucugaaauaaaaguagacaaugccauaauuacugcagugcccuuucugaggcucuaacuggugacuacauuaaaauaccuggaaaacuggaaaguaaagcuuccgugucucauagucacucccagauacucaguaucugugggaaaucuacagccucuauacagaaaacgagggcggaaagcaagcaauggggaaggggguguuaccuuuuauuuaauuagcacagagagaugagucagaggcugccuuccacgccuacagacuggccucuccucaaccgugccuacaaagucagacuugcugcaguccaaagcuauuugucagcuggacaggucagcuacagagcugcccaagaaaacauauuugaaugagcaaccaucaagcaacucuccaacuaagagugcaaccuucacucuccauacuguucaagguaagugacagaggauuaccugacaaccugaauuuagcuacacuacacaaagacacuccuaagccacccuuccuguaucagcucaccagugagcuauacagaguagucccuccuuacccaaggaggauguguuccaagauccccaguggaugccugaaaguguggauaguacccaaccccauauauacuguguuuuuuccuguauauacauaccuaugagaaaguuuuguuguuuaagacagggucucacucugucacccaggcuggagugcagugacacaaccauggcucacugcagccucgaccucccugggcucaggugauccucccaccucagccucccaaguagcugggacuauauaggcacacacaccaccaugcccuggcuaauuuuuguuuuuuguagagacaggguuucuccauguugcccaggcuggucucuaacuccugggcucaagugauccacccaccucagccucugaaagugcugggauuacaggcaugagccaccuugccuggccucaugaugaaguuuaauuucuaaauuaggcacaguuaagagauuaacaacaauaagaaauaauaaaaucaaacucuuaugacacuaugccaacaucacuacucuugcgcuuuggggccacuaagucaaauauaggugacuugaacgacuugaacacaaagacugcaauucugcgacaguggaucugauaaccgagauggcuccuaagugacuaaggggugaggagcauagguagacagcuagacagcauggagaugcuggccagaauugauucacaucccggugggauggagugagguuucaucacacuauucagaacagggcauaauuuaaaccugugaauuguuuauuucuggaauuuuccacuuaauauuuucauaccccaauagaccucagguaacugaaaccacagaaagcaaaacugcaaguaaagggguacuaccguauuuagccaacaucaaccaaaacaccaccuugacagaacaauuauagggcacuuuacugcauugugcccacaucuuuauaaagaugaacaggaaaauaaaagugccagugcuagugauaagaaacacaggccucaauguuaaugcaguggaagcaaagauggccaccaucauacagcaggaaaacagugacucaaccaccauuuggacagacguuaucugugaaaguaauuguaaaaagaaaaggucaaaguuaaagaaaauguugaaaaugacagaaauauauugucaaugaugccaucuaacagagaugaaauuagggauuuuuuuucauuacuuuuguccuuuugggaauagaaacacacccaaaccucuuaaugcaaaagcucauuaagugacuuucacacauucaacauuaacaccucugaagaaaccaucaggccggguacgguggcucacgccuguaaucccagcacuuugggaggccaaggcggguggaucacgaggucaggagaucgagaccauccugacuaacauggugaaaccccgucucuacuaaaaauacaaaaaaauuagccgggcguggugaugggugccuguagucccagcuacucgggaggcugaggcgggagaauggugugaaccugggaggcggagcuugcagugagccgagaucgcaccacugcacuccagccugggcaacacagcgagacucugucuccaaaaaaaaaaagaaaccaucaaguuugaagguagaagacuaucuacauaugaauguaaacccagaaaacauuaacagcuacaauaaguggugggugcauguuaaaaaaaacuuuaucagucaccucauaauuaugcaaaaagagugggaucaaauacagcacuuccaacaaaaucccaacuuugcaaaguaaaauuauaaauaucggccgggcacaguggcucaguccuguaauaccagcacuuugggaggcugaggcgggcagaucaccugagaucaggaguucaagaccagccuagccaacauggggaaaccccaucucuacuaaaaacacaaaauuagcugggcgugguggcgggcaccuguaaucccagcuacucaggagacugaggcaggagaacugcuugaaccugggaggcggagguugcagugagccaagaucacgccauugcacuccagccucggcaacaagagcgaaaacucugucucaaaaauaaaaaaaaauaaaauaauaaauauuaaauauaaguaacugacuauaaagcaucaaaaugugguucucucuggguaaugauaugugugauuucccucuguuucacaaauacuucccacauuguucaaaaaaguaucaucauggaaauaaugaauuuuuguaauuggaucccuuccaguggaagcaccauguaauauaaugaggaccuaacauuuccaaucacuauaaacaaagagcaauagggaacaagaguucuguaaccaaaagagcucaacaggggguucagcuaggucacaauaagugcucugcuuauaagaagagaggaaacauccuugcaguagccaggauuuaauuccaaugcaucagaugacccaguacuaaguggugcaaucaaguccacgaagcagaaauucugugaggacucucaaaacaagagaaagaucauuacugaggaaacauuaauugagcugggaccucaaaguagagauuuggguuuuacagugaagaaggaaggacauuuugggggaaacaucaucauuauuauuauuuuuugaaacggagucucgcugucuugcccaagcuggagugaagugccaugaucuuggcucacagcaacuucagccucccagguucaagcgacucuccugccucagccuccugaguagcugggauuacaggcauaugccaucacgcccaguuaauuuuuauauuuuuaguagagacaggguuucgccauguuggccaggcuggucucgaacuccgcccaccugagccucccaaagugcugggauuauaggcgugagccaccaugcccggccuggaaucaucauuauuguaugugguguguaauuuauuuuuuaaauaagucuucuucauggacucuguguauguggguguguguuuuaagcugcauuauaggggcaucaguugcccugauaagaccccuauuccagcaaacauuuaaucaaaggccacacagcuggccuaauugcauuuacagcgaccaacccuuuguaacuuuucacuuuccugacucuugagccaccgcucacuccccuccuuacucccuuaugcucacuuuaaaaggccuagucaccucugcacaaaaucgaauggagcucagcucuuuccccuacagucaauaguuacugaauaaacguguuuuuacugcuuuaacuaaugucccgcuuuguuuaucuuugaugauggauaguuccugguggcauucaaggcuuuguuaauuaacauaacggacaucagaaaugaguuuuacuagccugggcagcaaagccagacccagucucuacaaaaauuuuuaaaaacuggccaggcaugguagaacgcaccuguagucccagcuacuugggaggcugaagcagaaagauugcuugaccccaggaguuggaggcugcagugagcuaugauugagccacugcaauccagccugggcaagagcuagaucccaucuuuaaauacauacaugcauacauacauacauacauacauacauacauacauacauacauacauggguuuucauugaggaaaaucuuggugaucuagaaauaggaucuggcuggaaauaccugggccugggcauuccugccuugcauaaacuggcuauaaagauagagugaauagggccggcgcaguagcucaugccuguaaucccagcacuuugggaggcagaggcgggcgggucaccugaggucaggaguucgagaccagccuggccaagaugacaaaaccccaucucuacugaaaaugcaaaaauuagccagauguaguggcaagugccuguaaucccagcuauucaggaggcugaggcaggagaaucgcuuggacccgggaggcggagguugcagggagccaagauugcgccacugcacuccagccugggugacagaaugagacgcugucucaaaaaaaaaaaaaaaaagacagagugaaccuuuacucagaauggcaaccacaggcuugauccuccuggugcaauagucuuggcugcccaccaaccagacauuagcugagucuugccuacuagaauguuggcgcaucugccucgggugaacuuuucaggcaagaagccuauuaauuucagcauuauuauugucauaaaugccuauacuugccugcagcaagcccucccaaucccuauugucaaacugccuuggaaagguugucuagauuuuccaagcacacaccucacuuccgcucugacagugagcacugucauuuucuuuucuuuuccuuuuuuuuuuuuuuuuuuuuuugagacagcgucucacucuguugcucaggcuagggugcagugcucaauaucagcucacugcaaccugcaccuuccaaguucaagugauucuggugccucagccucccaaguagcugggaauacaggucgugcaccaucacgccuggcuaauuuuuguuuuaguagagacaggguuucaccauguugcccaggcuggucucgaacuccuggccucaagcgauccaccugccucggccucccaaagugcugggauuacaggcaagagccaccaugcccagccugcacugucauuuucuguagcuaacuucccccaacacucccaccuccacauagcccuuaaguuaaaggagaacaaggaagcccuguguucauuaccgugucucuaggggccuagcacagaacuuugaacccauaaaguguugagugaccacuccccuguaaucucuacuuucuuagcauccauuagccaacagccuaagcaaaaccaaagugaauaucagaguagauacaaaaauaaaauaagcugaucuggauauuauccugaugcagauggguaauggccacuaauaagauuugggggguuccucacacucugccaaauccuauauuacagacuuuacacuuaucaucacauguaauuuucccaauaacccuaagaaguacccauucaauaguugagguaaaaugaggucauagaggguaaguaacucauccagucacaccaguccucauuguccagauuuccaaauugaaacccaggccugaguccaaagcccaggcucuuuuauggguuacauauuguucaggaugguccgcaguuaaagaaagucaccaaaaugucucucuccgaccucaaacuucucccgaccuaaauaccuaauuggugacuugccauuuccauuaaauuuauaauaggcaucucuaauguaacgaagccaagaaacuuggguuuuccucaccaaauguccucuuccuaacaauuuccuacuucaccucaguaaugcgaucaucaucuacccaguggcucaggccagaaaccgagccugucucauucccacaucccacuucuaauccuugcucaaauccaguucuaccucugaaauauacccaaagccaaugaugucccacuguacucacuccuacagccauagccuaaauuaagguaccacgcugucuccuccugggacuacagcaacagcagauugccaggauucgagcuccaucaggaaaggauuuuuguucacugccgaagccuagaacacugcuugccccuaagaggcaaauauccacuuagguuuuccucaccaacugcuucaugaccaacucgaacugcuuuccucaccuccacucuagcccguuacaguccagucuucacgacaucccaauuaucuucuaagugcaaaucaaaccacagcucgccccugcucagaauccucccacagccucucacugcaaccagaauuaaauccaaaguccaaaggcagcugacagguucuggccauuucugguccugcucuucucucugaccucaucuaagacaccccagccacccuagacucccuugccucuccucacugagcagucucaacuccacaggcaucuucucagacucccucggcaacccuccucaaggcugcuuaccacacggccuucugacaguaccaguaccauauucauuguuucauuguuuacauguuuaugaaugaucuccccugcccagauaggccauugagagcagagaugcuugucugacuuaugacuauauagcaggcuccuggcaaaaggcaggugcccacagaaacaaacaagaauugguaacuucugacggugcugugagguuuuguuugcuuuccuuucuuuugagauggaguuuugcucuuuuugcucauugcccaggcuugagugcaauggcgugaucucagcucaccacaaccucugccucuggguucaagcgauucuccugccuuagcuguguagcugggauuacaggcaugcgucaucacacccggcaauuuuguguuuuuaguagagaugagguuucuccacguuggucaggcuggucuccaacuccugaucucaggugauccgcccgccucugccucccaaagugcugggauuacaggcaugagccacugcgcccagccuguuugcuuuucuuuuaacuuccuaccgccccauccacaggaaaucacagugugaucaccaucacacagcacugaggcccaccacagugaugccuccagcaggccugggaaagcagggguuaacuuugauuugguucuuuccaaaguccuaagaggggagacuuuagaaaccugcuaaaacaucaacagcaaaauaauucuuuuacaaaacccauuugaauacugguaauuacagagcucuaaauuaggaacuugggaauggcagaaagagccucaaggggacuucaagggaccaggacagaugccccuaaagagcuguaucauuacuacguaauaaaaagugucgcaucauauuggagaaaaaguauuucaaaacgggaauaaaagauuugcagagcuuucugaaaacagucuuuccugguccaccuuguucucaaauaccugguaagguggugaccauucucauucucuuucucucucugccugacacagggaaaaaaaaucauuucgucucagucgucaaaagccucaauuuccucaacucugaaaaggccagcuuuaauguaugccaagcacaguauuagaccucaaaaaccaagacagcuccacguggccacucuaaacaggacagauuaucugccaguauaaucgccgguuacagaaacccacaguuuaaccacuccaucacuuacagcuggccucgauuguggaaaggcugagugucagcaagaacaccccgaaccaggaugcucccuagagucugauucguucgugaaaacacuccauuaaaacucuguaccgaaacgcugauaauccacauguaaagggagaaaagagcuccacauccaagagacucaccuacuucguuuuuucuaacucugcaggaaggagugaaaccagcauuacagggcuaagacguacuaauucuacacugaugcaguaacugguaggagacauaauguuuuaagacaucauagguuuaaauaggcgagaguuaaaaaacagguucgaacaaguuuauuugcaaagagaggcaggaagguuccagcccuacccaggcagucgugcuaguaccgagccaggguugggucgggaaauucaggaagcagggcugaguuuucccuucgcccagaccugcgcccgguaguuuggaagucaggcuucgagacauucucaaagguacagagcccacgcucgacuacgagaugccaagcgcaaccugccuggguuguuugacccgaguuuuauucagggcauagcaaaggagacggugccuaaacccacuuuucuuccuggauucauccgacaagcagaguggagagggcuacggagcucagcgcuauucaccagugcucggcgcaagaggcgacacgccccuggagcagucgggauccuccgcccgagcccggcacgccccgcuccacgcggagucccggaggccggacgggaagaccccgggguagccucucgggcuucccccugccccuucccgcccgcccagggcacaggauuucccggacggcugagcgccgcggggccagcccgagcgacccacccgggcccuacguucggccgcggagcugggagcgcacccaggcagguccuccacgccuggacuccuggcccgguucuccgaucugacaacccccgcgcugcgcccggccucgcucaccuggcccgcacagcacugagcugacaucgcggcggccaaugccgaaggcgcgcucgcuggcuccccgcgccgcacgggcccuccuggcugccucgcgccucgagcgcugggcucagccgcagcucacacuugaacgaagaucagccucggcgaagcgccuaggcgccgaggccuggguaaaaac

SEQ ID NO: 192446 - RNA, 91114 nt, Homo sapiens
acgucccucguggagccgccgacgucagcagucgaauggcaacauuguggcgaugcugaggcgcagaguuuaggagacggguucaucagucaggccggcuccgggcuuucugcagcagcaccaggggcgggggcggggaucuugaccugggcgagcgaccgggacgcauacagcgccggccugaccccgcgggacccgcgccucaccaccggagcgccgcagacgcagcuccacggccucgcgcggggggcggcgggcggccgcgaggcgcugcggcagcgcggagcuuguaaacagauccggccgcaggugaccaugugaacuaccugcucccgggacgcuuauuguccuucucucgauccgcgccacaaaggagcucggcggucggggcgcggagggacaggcgaacgagccgggagagccggccggcgcacuaagauggcugaaggcgcccggcgagggugagcggggggcgcggcgcagccagcggggaguccucgggcgggccgggccggcggcccuuccccgcggcgagaagccggagccaccaugucguucgcgcuggaggagacgcucgagucggacuggguggcugugcggccccauguguucgacgagcgcgagaaacacaaauucgucuuuauuguggccuggaacgagauugagggcaaguuugccauaaccugccacaaccggacggcccagaggcagaggagcggcucccgggagcaagcgggggcgcgagggggcgccgaggccggcggagcugcguccgacgggagccgcgggcccggcagcccggcgggcaggggucggcccgaggccacugccucugcaacucugguuaggagccccgggccccggcggagcucggccugggcggagggcggcucuccucggagcacucgcagccuucugggggacccgcggcugcggaguccuggcagcaaaggggcggagagucgucuuaggagcccagugcgggccaaacccaucccgggucagaaaacaucugaagccgacgaugcggcgggggcagccgcugcagcagcccggccggcgcccagagaggcccagguguccucuguacggauagugagcgccucugggacggucuccgaggagauagaggugcuggaaauggugaaggaggacgaggcaccucuggcgcucucggacgcggagcagccgccgcccgccaccgagcuggagucuccggccgaagagugcagcugggccggacuguuuucuuuccaggaccugcgcgccgugcaccagcagcugugcucggugaacucgcaguuggagccgugccugccgguguuccccgaggaaccuucgggcauguggacugugcuguuugggggcgcccccgagaugaccgagcaggaaaucgacacucuguguuaccagcuccaggucuaccugggccacggccuggacaccugcggcuggaagauccucucccaggugcucuucaccgagaccgaugaucccgaggaguauuacgaaagccucagcgagcugcggcagaagggcuacgaagaagugcuucagcgggccaggaagcgcauccaggaggugagugagugagcuccuagucugggcucuacuggucgcuuuugguuuacuggccaaaccaaaggcuggagccucggugucgggugugcgcaguaggacgguuguuuuucuggacaagcggaaaccaagagggguuccugaucuaccuugcccuucaucccucucgguggcugcuuaauugacucucugaaggaccuucgucuuuauuuccucccccauuuaucaaaaguaguaagugcgcucuguguacuacucaguacugguaaugcgcaauuaaagccacuaagaaaaguguucuguaagcaugggcuaccugagcauuuuucuaccccuaaagcucuuccagcaauaacugcccagaugucaacucuucuuuguccuugucaccuuuauuuaaaauaguuugucuuacggagcaaaguugaucuguuuugauucuucuuugugcaguguggcaaccuacgcaaauuuuaaauucauuuuuaaacgagugaccuaagugaaaaagcaccuagugacuaucggaugcaaauuuauuuuuaaaagguuuuuuagaaguguuuuguuucuuuuuuuuuggacuaccucaggucuuuacagauggcucagguuucacugcuguuuuagguagaaauaaagauucugggcaggaauguucguuguauuuuuguacuuacuguagaaguacaaaagccuuuucaaacuaauccuuaaaauaacaaaaaaaaaguggaagaaagggucugaauggauauacauauggggcucuagaauguguaggaaauguguaauucaugccugcucacuagcuucugcugaaggaacuuuacuaaaaaagucuuuuaaaauagacccaguuuucccuaauggauacuacuacacguaguuucucaaagcaaguuacuguuuuuacuauuaaugcaauugagauugguggagaaaugcacccccgcccuccgcgccuucuuuuuuuuuuuuuuuuuuggaagcaguuuugcuccgucucccaggcuggaguacaguggcaccaucugggcucacugcagccucccccucccggguucaagcgauucuccugccucagacuccugaguagcugggacuacaggugcgcgccaccacgcccggcuaacacguuagcccggcuacuuuuuguguuuuuaguagagacgggguuucaccaucuuggccaguauggucucgaucuccugaccucgugauccgcccgccucggccucccaaagugcugggauuacaggcgugagccacugugcccggccugaaaugccccuuuuaaugguguuuauauuccuaagauuguguuguuaucugcuuauguauauauaauaguugaaccuuguuguuagauuagggagcuagagccucauguuuuuuucguagaauauuagauauuuuucuuuauuagauuugaguauuuaagaaauguuuguuucucacuuauaccauaguacucucuuacaacuucccgaauccagauuuucacugcuuccuguugguuuacuguaugcuaaaugucacccacuauaacaugauccuagaguuccagggaucuguuuuuauuucccuuuuuuaucaccucacuucgggagucuaccuuaaauuauuuugaaggaagugacaaaucuuaagugaccacauauauucucagaaguguuugguuaauauugaccuguauuucucuuaaacugcaagaaccguuagugcuucuuucucuuauuagauuuacagauauauuuuuuaaaauacauauucuuaaaaaucccuuaaugaaugggccugucugauuguaacuuuuuggauacucagaaaaagcgacugucaggccggucgcgguggcucaugccuguaaucccaacacuuugggaggccgaggcgggcggaucacgaggucaggagaucgagaccauccuggcuaacacggugaaaccccgucucuacuaaaaauacaaaagaaaaaauuagccgggugugguggcgggcaccuguaguccuagcuacugggaggcugaggcaggagaauggcgugaacccaggaggcguagcuugcaaugagcugagaucaugccagugcacucgagccugggcgacagagcgagacuccgucucaaaaaaaaaaaagaaaagaaaaagaaaaagagaaaaagcgacuaucuccgguuuuuuaauucaaaugggucaaaaauaagcucucaaaaaauauaauuuucuagaacucuuuaaaaaggggauuacauuuuuuaaaaaauguguuccuaauuaagguucucuugaccauaaugauuuauuuucuuuaacagaaaauuauacuuuuuuucuuucuuuuuuuuuuugagauggagucucgcucugucgcccaggcugaaguguaguggcgcgaucuuggcucacugcaaccucugccucccggguuccagugauucuccucccucagccuccugaguagcugggauuauaggcgugugccaccuuguccggcuaauuuuuguauuuuuaguagagaugggguuuuaccauguuggccaagcuggucucgaacuccugaccuggugauccgccugccucagcuucccaaagugcuagaauuacaggcgugagccaccgcacccagccuccccccgcccccuccaaacagaguuuugcacuauugcccaggcuggacuguacuggugcaaucucagcucacugcaaccuccaccucccggguucaagcaguucuccuugcucagccucccaaguagcugugauuacagucgccgcuaccaugccuggcuaauuuuuguauuuuuguagugacaggguuucccaguguuggccaggcuggucuugaacuccugaccucaggugaucuaacugccucggccucccaaagugcuaggauuacaggcgugaaccacugcacccggcaacuucaauauuugaaaaauagccaucaaggacaacaaauaguuucaguaauaaugccuaucuugacuucugcuggaagauugugucuuuagauuauauugggggagggagggaaguguggugugauugauuggugaugucugccaugggcaugauaaugaaaguguauaggaugcuagccauguauuugucuuaagcuaauuaaauuuaacuuugcuuucuuaauaguuugcaguaacauuuuuuaagguaacauuuuuauagaaguugugccauguuuguguuauucuauugacuuaguuuguggaauuggcuauagcuuuucaagcuagguuuaucugauaaaucaaaugcauucuugaggauauguuacuuuugaggauauguuagaaugcuuaguccuuuggucacuuacaauacuuaguccuuuuccuucuuuaauuucuaugaaucuauuuuuuggucuuuuuuccuacaguauuccuuucccuguccauuuaaagguuucaacuuaaaaucaccuguuuuuguucaaaaugguuaguaaguuguugaacuuuuuuuuguuuguuuuuaauagaacagacuguacaacuagauuguaagcuuuucaagguccuuggcuuugacaauaccuuggaacucucuucuuugccaccccuaguucaggaccacacaucuugugagcacucuuaauuaguggauaaaggaaacuagagaaguuuuuaaaauuaauuuauucuuacuauugcaagaauuuaaaggacuuagaagauguguccuuuuaaugugaaguuguaaguaaaauuuuuauaaauugauaaguguaaauuccucaaaggacaguguuuuuaaaacgagaaauuuucuuuuaguacuucaaaggaaaauuucuuaaaacauaaauaaauuccucaguaagagguuuuuacuuggggauggugaauucccuguaagaggggcuauggauggauuuuaauggggcguccugccgaguuuuauaucugugggcaugugugcauuuuagagagaaaggcaauaaugugagucacaggaauguuuugguuucacagugcguuuaaaaguuauguuuaugcuauaauguacauuauacuucuuaggggcuaaauccaagugaaaggugaaauuuguuacugguauguuugaauuuggacuuuuacaagaguuuacuauuggaagcaguauuuauacaguagacacugaaucaguccuuaaaugaaugcaggugccaccaagaccucuuugaacaguuuucagcaguagccuugguuguuggucagagcugagguuuguauuaguguaugugcguugguggcccauacugcagcuuagguuugaccuggauuuuauaaauaaugguuucuguauaaggacagcuauucucaagaugauuaacuguggugcuuuagauaguaaaccuuaauuaugaugguaggcuugauuaagaucuaaucaucaguguucauuuuggaauuuauuauguuuauaaagaugugcucaauucuaacuucucuucuguugaaaccacgguuuggaaguagcauguguuuucaaaauuauccguguaagccacauaauaaauagccuguugagugaguggagucagaaacaccuagguugaaaauaggacuaaccacuucugaugaccugcuuaguuauuuaaccucuuuuaaaaaggaaggugggggaaauaaaggaugucuuaagauuugaguaagacaguaugagaaagggccuaacaaagugccuggcacuuacuaaagaggcuuccaggaaguguuauuuucccuuuuuucauguaacaaggauuaucugguuuuccauucagcccuuuuuguggggacuguaacuaauauuuauuauucacuaucugcugagaucaguggguguuuuauaccuauuuuacugaggcagaaaaugagacuuaaagagguccuguggacuucaccaaggcuaaacagcugaguaaccaagcuccgaugaaagccuagauuugucuuaauccaaacgugugccuuuucugccaugccuguggccuguugggguucuuaauccaagggacuguauuccuuccuuaaagagaaaggaugucaaucucuacucuugagaauuggggagugguauuauuuuaaaaugcagucaguucaauaaugacuuuuuuuuuuuuuuuuuaaagacagugucucacucuguugcccaggcuggaguacaauggcaguaucucagcucacugcaaccucugccuuccaaguucacgcaauucuuuugcuucagccucccaaguagcugggauuacacgugcaugcaaacacucaauaacugcuuuugauuuaggauaacucauuucgaauuaauuaugacaagcaugagguagggcagucugaaugugauguuuuagagaaagguguugccuaguggugcaaggauagguuuauguuagagaagagugcccaauuguggggaaguuuuuuguuuguuuuguuuuuguaucuuaauggcuaagcuggaaaacagcuccugacuucugagguuauuuaacugaaggggcaaggggcaaggagcucuaggaggaaguuuuguuuaacagguguccucccaaggauaccuuuggguccuuagaaaauaacuuuucuaauuuucuugaaaaccuaagauuaguuuuaaaacucaagcccugcugaaaccccaacuauauacauuagagaaaugacaguacuuuaggagucuugggacgccaccugucuuucacugggccagcaagccaugacccaugauuacauauaaauaaaugguggaagcaggcugcuauuuauagggaaggauauaauaugauuccaaugaagagagcugcucugucuggcaguucuugacugcauugacuggaaguauugaaaaauaggauauuacauguugaggacauaugggagcuguagacuuucaagacagaagauaugucaacauuguagcuugaugccuugucuaaccauguuauacucccaugaaaauauugcaaacugcucuuuuacuguaaaauacaguuaaagaauaaugaaacuaagugaauuugugggauucuuaaaguauugaugaaagacuugaaaguuggaaacauuuacaauauuuugaugcuaaucauuuucuucaauccuguacccaaauguacuuuuagacaguuuuuugcaucacugaaaaagauguaaguauagaaaaauggauauaugcuucuaguuuagggcuucuauaaaacaaaaacauggagacugguagcaggaugucacccuucuugguaauuaauuuguguaaugguuucucugcuugccacuuaacaucacaagaugcccaguccaccagagauuucuuucuuuuuucuuuuuuuccuuuuuuuuuuuuuugagacaggcuugcucugucacccaggcuggagugcaguggugugaucucggcucacugcagccuccacugcccggcuucuagcgauucuccugccucagccuccugaguaacugggauuacaagcaugugccaccacacccagcuaacuuuuguauuuuuaguagagaugggguuucaccauguuggccaggcuggucucgaacuccugaccucaggugauccaccugcuucggccucccacagugcugggauuacaagcaugagccaccacgccuggcccagauacuucauagacaugaagucuggggauguuuccuccuugcuaaaaugagguuaacuuagacaacacuucagugauauuauuauaagggaguguguaugugugucugagagagauggggagagaagggagaagaugggugggaaaauugguuugucaaacauagcagcugcuguauuugaauuagccaucuuaucuuugcaaauucucacauguaauuuuaaucgaucuguuaaccuucuccauugcugcuucauuugacguuucauuaacuguaaaauauuuuugacaguaggucuugaaagcacaagaugagcccucuguugcuccauugaugguuaaauguaugugugccuauuuuuuuuuuuuuugguaacgagaaguuuccuguggcucuuuucacucucuaaaaggccaggaccugcuuccucugaaucugccugauucacucaguuguugguaggagaaauuaaguuccaaguguaagagacauaggcacugaaaacuaaauaauaguucuuguaacuauuuguuuuuuuuuuuuuugguagagauagugaaguucauuugguuuuucaggcuucuuuuaggggacuugauaauaccaaguagccuuaacacagcauaucuaaguuauuaaacugcauaggggcagagaagaauuuauccagcaaaaggccagaaaauuuggaguuguuuuccuaaaugugggggauuguccuuuauguuuguccuugaauuuuaaauuaaauauaauuacaauucuauauaguagacucuuuuucagacuguagcaaagguucuauaaaaugggcugugaaauaauggggcugauggguuagacauuucacagaggaggauuuuuaaggauaaauguaugaaguuacuuuaaugauucggaauuuuauuuguaacuuucagguuugaggguaguggcuagggucuuaguuuauucaacaaauaguaguauaggcacugggaaaaugcagugaugaacacuguuucuuugggaagaaauuuuaaauaaaauuggucaugaagucauccuggugcuuggagguaguugaagcagggugcuuuuucagaagcaucccacuacacugucuugagugcuucauggaaaaaaaaaaauuaaauggauauggcucgggaaaaaucuguauuuuuguccugauuguaauaugaguuguuugaccuuaggcuguugacuagccuuuuugggccuuaguuuuuaguuuauaaagugagguaaguauggccucuuuuuaaaggacccacagcaguugauaggcacaguguggcaaggguugggaccugagcaacuugguuuuuuucuuuuuuugagaugaggccucacucugucgcccagacuggagugcaguggcaugacuuuggcucacugcaaccuccgccucccagguucaaaugauuauucugccucagucuccuggguagcugggauuacaggcaucugccaccauacccagcuaauuuuuguauuuuuaauagagacggguuuucacuguguuggccaggcuggucuugaacuccuaaacucagguauccaucugccucagccucccaaaguucugggauuacaggugugagccacugcacccagccuguauucagguuuccaucuccuugcaguaagaugacuguugaaaucgcagcacuuuuaauauugcuaguguuuuuaggcuuugagaaagccuaaauucacuuugaaguacaaagggcauuugaauauggcaguaguguuucauuuuguguguguuuauccuuacauccuuaaaucauucauuacuuauacuucaaauuuucuguucuuuuuucacuucucccugugguuuuuaguauuaaaacugcuuuuccgaucaguuuuugauaacugaaaguuauacuugcaaagugaaugcuuacuuauuaaaauuauuucucuaggccuaucuuucuccuugccguccuaucuagaugaguuucuauccacaccuauggggccauaacuggaguguguauaaggauguauauaacaaguuuucaauaacugcaauaguuaguuaaccuuuauugaaugcuuacuguaggccaagcacuuuacaaagaucuuuguguacauuaucucaguucacacguagauuagacaguaagagguaggaugcaagugaguuugagaccugacuucuccuuguuaauaucugugauuuugggcaaguuaccugaugcagugccuuagcuucuucaucuguagagagauuaauacugcugccucauagagugauuuaaaaauagguauguuggccgggcacaguaucucacgccuguaaucccagcacuuugggaggccgaggcaggcggaucaugaggucaagaguuugagacuagccuggccaacaugguaaaacccugucucuacuaaaaaugcgaaaauuagcugggugugguguuggacaccuguaaucccagcuaacuugggaggcugaggcaggagaaucacuugaaccugggagguagagguugcagugagccaagauugcggcacugcacucuagccugggcgacagagcaagacaccaucucaaaaaaaaaaaaguaugcuauaaagcacucagaacagugccuggcaucuaguaaacacuugauaaaucuaaacuuugauuaauauuuguaucuaccuaagagauaaggauuuugcagcagagguagagaauugguaaauuugccuacauaacguaucuauuguaugaaagaaccggauucaaauccaagccugccuuguuaaccacuggacugucugcaucccuguagaaagagagugaggauaagugauaaauuuaaauguuguccaauugaaauauauguucagugucucaacaguggacaaaagcaauagugcuuagcugaugauauuuuuggaaaaucuuaauuauauacauauacuguaauuaccuuuuuuuguuugggauuagagaaugaugcaauccaaaggaggcuacuuuauuuuuccuuuuuauuuuuugagauggagucucacucugucacccaggcuggagugugguggcgugaucucgguucacugcaaccuccaccucucggguucaagugauucucccacuucaaccuuguagucucaaguaguugggacuacaggcaggugccaccacaccuggcuaauuuuuuguauuuuuuaguuguuguugaaacaggguuucaccauguugcccaugcgggucucagucuccugagcucaagccaucugccugccucagucuccuaaaguauugggauuauaaacgugagccaccuugcccggccccugcuaucacuucuauuuccuuuuuauuuuguuuauuuauuuauuuauuuuuugaggcggagucuugcucuguugcccaggauggaguauaguggcacaaucucugcucacugcaacuuccaccucccagguucaagcaauucuccugccucagccucccaaguagcugggauuacaggcacccgccaccaugccuggguaacuuuuguauuuuuguauuuuauuuuauuuuauuuuauuuuuuauauuuuauuuuauuuuauuuuauauuuuauuuuauuuuauuuuauuuugagacagagucucguucugcugcucaggcuggagugcaguggcagaaucuuggcucacugcaaccuccaccucccagguucagguguuucuucugccucugccuccugaguagcugggacuacagguacacaccaccacaccuggcuaauuuuuguauuuuuaguagagaugggguuucaccauauuggccuggcuggucucaaacuccugaccucaugauccgcccaccucggccucccaaagugcugggauuacaggcgugagccaccgcaucuggccuuuuaacuuuuguauuuuuaguagagacgggauuucaccaaguuggccaggcuggucucgaacuccuggccuuauuuccauuuuaaauaguccauaacauugaauuuagucuuguacuuuccucccuuuuuuuugagacagagucucccucugucacccaggcuggagugcaguggcacgaucucggcucacugcagccucugccucccaggugcaagcaauucuccugccucagccucccaaguagcugggguuacaggugcgugcuaccacacccagcuaaguuuuuuguauuuuuaguagagaugggguuucaccauguuggccaggcugaucucaaacuccugaccucaggugauccacccgccucagccucccaaagugcugggauuauaagcuugagccaccgcgccggccuccuucuuauaauuauaguaaauaauuaccucaccucagucccauauagaaaaaaaaaaaaguuucuuacuaacaauuuuucugacuaguccagaagggaggacaguuaaggauguuaauuucuuacuuuauuuucaguuuagaaauccuacaucuguauguuuaagagagggucuuguucugucagcgcaggcuggaaugcaguggugccgucauggcucacuguauguagccuugaucuccugggcucuagugauccucccgccucagucucuggaguagcuggaacuacagguguguaccaccacgucuggcugacuuuuuaauuuuuauuuuguagagaagaggucucacugugucaccuaggcuggucucaaacuccugaguucaacuuauccucccgccuugcccucccaaaguucugagacugcagacaugagccacugugccugcccuuuuuuuucccucuuguuaggugaugugaauuuugguagugggguugcuaaugaaaaguuuaugaaaaguaggguuaaagaaaugaaggacuaagaaaaacggugugaauuaacuucauuauuguuauuuuguguuuuuaguagaaauggaguuuugccauauuggccaggcuggucucaaacuccugagcucaagcaguccuccugcauuggccucccaaagugcugggauuacaggugugagccaccgugccugcccuugugaauuaauuuuagaguagcaguauuuacacuugaaaauuucaugggaaugaauaacauuaguuuaccaaaaggaaaugauaugccagcucauagugaagcugccuagaugcuugcuuuuguaaacaguauguuaucaagucacuggcucccuguauagccuuggaguuggcucuugagcagguuuuacucugcauugagccuuaugagacccauaacuugaaguaagacuguucuauuucuugguagaaauuaucuuaaaggagaugaauggaggaacagguauuuaucugaaguaucagcauguuuuuggguuuaaaaauugaaaacuggaaggaauuucaaaauugaguaauguuuuucucuuuucauuuugucuaacugcaccauuccccaguuacucuauucaaguuuuccuuuuguauuaaauuucaucguauuuucagucucccuugacucaagauugggaucuuucccuuaaggaaagaugaauugacuggccuugaguagaggccauguggggcagugguuccagaguuugaguuaggcuacagggguucauaccucacuucuacuuuccacuagcuuaacucuugguaguaacugagcuuucugcccgugguucuucaucucuaaaauggcauaauaacuauauaccuacaucauaagauuguuaggaagaaugaaagaauguacgugaagugccuagcgugguaucuaauauagaaaccgucauaaaugucagcugcuauugugauacuuucucaucuacuuuuuccugaagcaacucauacugaugcuggguuccuccuaaacccaaacuuguuuguacuaaaaaccguguuuguaauggaagcuggugcuguacagguaaaauauuuccaagccaaaacaaugucaaaacaacaagaaaaaucuaacggguugaucuucagccuccuguacccuccauaggaacuccuaguacgugcuuucccaagucccuuguugcugcuucguguauacauuauuauauucguugacaucacaggacaggugguccuuuugauacagucaguuaaaacggugauucuaguauuuuuucuugucaauuuuauugauagcucuucuccauuuuuuucuguauuuaccuuuacuuuguuuguaggcgucccagacaacccugaucacaauugauuugcaaauauuccaguugaaauaacuauuaaagaaaugguaagcauuaaccucuggaagcccuuaaaaauaccuuuaaaucuccuucaacaauuguuuauuuaauaaauagaucuuguguuagguauuuuuuaauuuuuaauuauuuuucuuuuuuuuuuuuuuuuuuggcauaugaaguaagagcuauccaggugcuuuuaacagccucucacacuucacuagaaauuuuaccccacuauuaauucuuucuaauuauaccuacuuuuuuuuuaauguuggcauuucugauuaguauuuucauacuuacucuagcaagauguuguauuuuaauaucuuucauugcacuuuuacauguuuacugugguuugggguagcuuugcaaagucuaaccauaacuuaaaauauugucuaugguaaaaaacaaaguuaaaugugccuuuaggguacaauauauuuaauaauugagaacugccuauaauucuucacuuuuauuucauuagugugauuuucaaaggauccagauuuauauuucuuaagaagaguauguagguauuuguauaugcugauuuuuuuaacaagccaauuuauuugacuguggaggguggggagaaagauuggaaaaaagucaaguuauuugaaaaugcccauuccuguuugguugggaaggagggaaaaaugaaugugauuuaagauagcugggcauaucuguaguuauuucuuuauuauaaauauauuuuauuauacuuugagacagaauaucccuccaucacccaggcuggaguacaguggcacaaucauggcucauugcagccucaaccuccuaggcucaagugauccucccaucucaggcuccugaguuacugggacuacagccaugcgccaccaugcccagcuaauuuuuaacuuaauuuugggggguacauaguagguguauauauuuauggaauacauaagauguuuugauacagauauguaaugcauaauaaucaaaucaugaaacauagggaauccguccccucaagcauuuguccuuuguuuugcaaacaauccaauuacacuauuaaauuauuauugacuguugucacccaguuaugcuaucaaauaccgggucucauucauucuauuuuuuuuuuuuuuacccauuagccgcccccaccucccccucaacuuccuuccuacccuucccacacucugguaaccaucauucuacucucuauuucaauugucuauuucaaugaguucaauuguugugauuuuuauuuuuuuauuuuuauuuauuuauuuauuuuuugagacaguuucacucuuguugcccaggcuggagugcaauggcaagauaucagcucacuggaaccucugccuccuggauucaagcgauucuucugccucagccucccgaguagcugggauuacaggcaugugccaccacgcccggcuaauuuuuuguauuuuuaguagagaugggguuucuccauguuggucaggcuguucuugaacucccgaccucaggugaucugccugccucggccucucaaagugcugggauuacaggcaugagccaccaugcccagccuuuucuucuuuuugauauaggcacuuauagcuauaaguuucccucuugguacugcuuuugcuguaucccauagguuuugguauguuguguuuccauuaugauuuguuuuaauaaauuuuccuucuuaauuucuucauugaccuacuggucauucaggagcauauuguuuaauuuccauguauuuguauaguuuccauaauuccucuuguuagugauuucuaguuuaucucauuuuggucagagaaaaugcuugauagucagguuuuuuuuuuuuuuuuuaauguuuuaaggcuugcuuugugacauaacauggccuauccuugagagugauagauaugcuaaggaaaagaacauguauucuguaucuguuggaugaaauguucuguaaguuuuuguuaggucuguuugaccuaugaugcaaauuaaguccaguguuucuuuguugauuuucugucuggaagaucuguccugcgcugaaagugggauguugaagucuccagguauuacuguauugaggccucucucucuuuagcucuaauauuugcuuuauaugucugggugcuccaguguuaggugcauauauauuuaaaauugcuauacccucuugcuaaauugaccccuuuaucacuauauaaugaccuucuuugucucuaguuguugucuugaaaucuauuuugucuaaguauagcuauuccugcuuuguuuccauugacauggaauaacuuuuucauguaugucuucauaggugaauguguuucuuguagguaacagaucauugggucuuguuuuuuaauccauucaguccaucugugucuaacaauuggagaguuuaguccauuugcauucaguguuauugauaaguaccuuauuccugccauuuuguuguuuucuguuuguuuuguggucuccucucucuuucuucaugucuuuuauugaaggugauuuuuucuggugauacuauuuaauuucuugaucuuuuucuuuuugcgaauccauuguauguuuuuuauguuuuuugguuugagguuaccaugaagcuugcaaauacuaucucaugacccaguauuuuaagcugauaacaacuuaccacuaauaaagacucuaaucuuaacuuugucuccccacuuuuuaacuuuuuguuguuucuuuuguuguuguuguuguuucuauauaucuuauuguaaguugucuaaccguuauuuuugauugguucaucauuuaaucuuuuuuuuuuggagauggagucucgcucugucgcccaggcuggagugcaguggcgcaaucucgggucacuacaaccuccgccuccuggguucaagcgauucuucugccucagccuccugaguaguugggauuacaggcauccgccaccaagcccagcugguuuuuuguguuuuuaguagagaugggguuucaccguguuagccaggauagucuugaucuccugaccucaugaucugcccaccgcagccucccaaagugcugggauuauaggcgugagccaccgcccagccugguucaucauuuaaucuuucuaagauaagaguagcuuacacaccacaguuacaguguuauaaucuguuuuucuguuuacuuacuauuaucagugaguuuuguacuuucagaugauuuuucuuuuuugagacagggucucacucugucuaggcuggaguacaguggcaugcaguggagugcaggcucaagcagugcccccaucucaaccucccuaguagcuggggccacaaguguaugccaccacucuuuauuuuuuuguagaaaugggguuuugccauguugcccaggcuggucucgaaauacugggcucaagugauccacccauccuguccccugaaagugcugguagaugacuuuuuuuuuuuuuuuuuuuuaaagacagagucuugcucugucacacaggcuacagugcaguggcuugaucuuggcucacugcaaccuccuccucccagguucaaaugaugcuccugccucagccuccugaguagcuggauuacaggugcccaccaccacgcccagcuauuuuuuuuuuuuuuguauuuuuaguagagacgggguuucgcgauguugggaaggcuugucucaaacuccugaccucguucgugaucugcccgccucagccuuccaaagugcugggauuacaggcaugagccaucacgccccagcuugguagaugacuuuuuuauugcucauuaauguccuuuucuuucugauugaaguacucccuuuagcauuucuuguagagcaggucugguguuaaugaaauuccucagcuuuugucagggaaagucuuuauuuucuccuucaaguuugaaaggauauuuuugcugguauucuauucuaggguaaaagauuuuucuuucagcacuuuaugucaugccgcucucuccuggccuguaaggcuucuacugaaaagucugcuaccagauguauuggagccucauuguauguuauuuguuucuuuucucucacuucuuuuaggaucuuuucuuuaucuuugacuguuggaaguuugauuauuaaaugccuuguagucuuuaguuaagucuucuugguguucuauaauaaccuucuuuuacuuggauauugguaucuuucucuagguuugggaaguucuguguuauuaucccuuugaauaaacuuucuaccccaucucucuaccuccucauuaaggccaauaacucuuagauuugcccuuucgaggcuauuuuuuaaauccugcagucacacuucauuguuuucucuuuuuuuuuuccucuugacuguauuuucaaauagucugucuucaagcucacuauuucuuucuucugcuugaucaguucugucauuaaaagccucugaugcauucauucuucaauaugccaauuguguuuuuuagcucuggaauuucugcuugguucuuuuauuucaaucucuuuauuaaguuugucugauagaaaucugaauuccuccucuguguuaucuugaaauucuuuuaguuuccccccaaaaaagcuacuuugaauucucugucugaaaggucacauaucucucucuccuuuuuuuugagacagggucuuguaguggugccaucucgacucacugcaacuuccaccucccagguucaagggauucuccugccuccgccuccugaguaccugggauuacaggcacccaccaccacgccuggcuaauuuuuguauuuuuaguagagaugggguuucgccauguuggccaggcuggucuggaacuccugaccucaauugaucugcuugccucggccucccaaaguucugguauuacaggagugugccacugcaccuggccacauaucucuguuucuauaggauugguuccugguggcuuauuuauuaauaguucauuuagugaugucauguuuuccuagaucaucuugguacuuguagauguucaucugugucugagcauugaagaguuagguauuuacugugaucugcacugucuggguuuguuuguaccuguccuucuugggaaggcuuuccacauauucuaaaggacuuggguguugugauguaagcuguaucuguuuuaggggacaccccaagcccaauauugcugugguuguugcagacucauaaagguaccaccuugauggucuuggucaagaugugaaagaauucacuggauuaccaggcaaagacucuuguucucuucccuuacuuuauccuuaacaacagaguuucucucucuguucugagccaucuagaccuggggguggagggacacaagcacuccuguggccaucaccacugggacugugcugagucagaccugaagccagcacagcacugggucucccccaaggccugcuauaaccacucccuggcuaccgccuacguucauucaaggcccuagggcucuacaaucagcaaguggcaaagccagccagccaggccugugcccuucccuucagagggaagaauucccccaggucccugauggguccuuucuggaagccagggacuagaaucagaaaccuuggaagucuaccugguguucuauuguauggcagcugagcuggcacucacaccacuagguggaguccuucccacuuuucccuccccuucccaguggcagaggaaccucaucccagaggaacaagcccagggggaguacuggcagacugcugcugauguucccuucaggcccaagggcucuuaagucaguuuguggugaauguugccuggccugggacucaccuuucaaccacccuucagggcaguagcuucuccuauaguccagggcagguucagaaaugccauccaagagucaaguccuggaaucagggaccccaugagcccacuugguguucuaccccaccguggcugaccugauagcuaaccuggugccaggaaucaagcagaaguagucucgccccaccccauagcuaccacagcugagaaugugcagagucucguaaaggguaauuugcaucaucuugcucuguccuauuccccuuagcuaacuuaaaaaauguuuuuuagggauggagucuguguuauccaggcuggucucgaacuguuggccucaagugauuguuccuuuuuggccuccaaaaguggugggauuacagaccugaaccacugcaccuguccuucuuucuuucuuuucugcaccuguucccauugugcugaccuuccugccuuccucccucccccacccuuccuuucauuucuuucuugcuugacagguucuccaucgccuaggguugcgaucauaguucacugcagucucaagucuugagcucaauucauccucccaccucagccucccuaguaacuagccgauauuacaggcaugagccaccaggcccagccauagccaagccuuuuaaaugcauuauuugcugaagucacuauacacaguccuauuuuugcuccauuauguacaccaucaccacugccuuuuuuuuuugguuaaguuccacauuccuuauuuuauuauuauuauuauuuuauuugauuuuauuuuuuuuuuugagauggagucucacucacucugucacccaggcuggagugcaguggugcgaucucggcucacugcaaucuuuaccucccagguucaagugauucuccugccucagccucccaaguagccgugauuacaggcgugagcuaccaugcccggcuaaguuccauacuucuuucuagguagggccagaucaggucccuucccuauagaaagucauuucugaccacuguaagaaaucagaggcuggacaugguggcucaugucuauaauccuaguacuuugggaggcugaggugagcggauugcuugaguccaagaguucaagagcagcguggugaacauggugaaacccugucucuacaaaaacuacaaaaauuugccaggcauggugauguaagccuguggucucagcugcuugugaggcugaggugggaggaucaccugaaaccaggaaugucgaggcugcaguaggccaugauugcaccacugcaugcuagcgugggcagcagcgugacccugucucaaacaaacaagaaaaaaucagaaauuguguuagaaauucagaaaucaaagaggcuuuauguugacagcugauaucauccauaacugccacccugguuuuucucuuuacggaccccucaugccccuuaaagugcauuguaagucccuaagagaugaaaacagauuaucuuuuuuuuuuggagacggagucuuacucuuguugcccaggcuggagugcaguggugcagucucgacucacugcaacuucugccuccuguguucaagcaauucuccugccucagccuccugaguagcugggauuauaggcaugcaccccaacaccuggcuaauuuuuguguuuuuaguagagacaggguuucaccauguuggccaggcuggucuugaacuccuaaccucaagugguccgccugccucagacucccaaagugcugggauuacagucaugagccacugugcccggccuuugauuuuuuauacauaacauguauguacagaguguguauguacauuuuaaugagagguauguauuuucccagggguagaacacagucaaauuuacugaaauuuacuacuuaucuacaaaggaaagaaucugaaaaucauuuuaaauaucaguuucuacaauauuuaucuuugaacuaaaaagaaauaaaaauaucaguuuggagcauuacuuuauaaauucagauauuagggcuuuuuuuguuuuuguuguuuuuuuuuuuuuuuugacagggucucccucuggcuggaguacagugguguuacgggauccuuggggugucgccucaccagccagaaacuuguguggccaguggugccuuugccugaguuuuccucuggccugcugggcucauucuacccacucagccuggcaggcugugcucagcuccugcuaccagucugggucccaugccugccaagggagagccagucauggagcggugagggguguguuagugagcguggggucuggccacugcauacaaccaggcacucuggcggugguggggcgggcagcuccaggugccaguacuggcaccagcucccuaugaggcuguggcuggaccagggauaccauaagcaguuuccauggcugacaccagggaaugcaguguggugccuggaagcuuggagacuccaggaacugcagcgccuuaaagagggugucaccgcucuggcuuggggagcuccuaggucugggcuccccagagggccacagcucuucuguccucuuguuggcuguaacauugugggcaagggguguuucagcccuguuuguguuacagcucuuuuagcccugccauucccugggucuugaguucuuguccugcauccagcaagaaugaaguacacagacaagagacaaguggagagugagcaagacaaagaggagcuuuauugagcaauagaacaacucagaggagaccuguagugggcagcuccucuccguagccagcaugucccgaugaguguucagcuuucagcagagaggguagcuccucucugaagcugguugucccaucauuucuucagcucucaguagagaggguagcuuuucucugcugggcaggucaucccgacgaguguccagcucucagaagagaggguaguucaucucuccagcuggcuaucuggucgucucuucagcccucagcagagaggagacccuggggugggcagcuucucucugcagcugcucucccaucaucuggcugaauauggggcuuuuaugggccucaggggaggaagugugugcgaaaugguccgugggcaaacaugggcgggccuggaaaaggcaccacaaguucccaccccagucaguaggaucagcagucugacacccaggcuucaggcccuccccgacuugaagguggugcuucaccaaggacucacccacuccugcccaggagcuugucugccuccugcugccauuuauggugcccaggcuguuugugccaaggagugucugugggccagcgcugagcugcccucagcacccccuuggccucucuucugugcucauuggugcccaaaguccgcagcaggcugaaguggcaggggcuggugugucagcacugcccccgagccugugcacacccagccagguugugacagaccuaggguuggccucaacuuugccuugugaguggaacaggcgcugauauugaggaaaguccaggcagugggagcagacaccuccgagccugcaggggcaagguggggccuucccaggccccggagagugcagagaugccuggaucugcagcuguagcuugggcagcuguagccaccccugggagggugggaauccugcaugccccuggcucccacuggcuccauggagcauggcauaugcacauccugggcccaccucugccucagggccccucucugccugccccucagugcccgacuguacugcuacccugcuggcaggcaacucagccuggccccauugcagugucucccaggacaguggucgagguacagguggcauggcagcccuggccagcgccacacaaaugaaccugacgcacccagggcuggccucacaaguccuagcuguacccuucagccaggugcucacagacccuugggaugcgguaggaagcaagguugaggcuguggcggagacuccaggccugggagugguuccugccuggcccugugauggugggggugguucagucaggugccuccaggacauggggcacaggaaacccacugccaccacugccgcucccacagcugcucuugccaccaccgcuuaugccuccccacugcaacugaugugauggcagcagccagucuagauggcccgccacugccaugaguggcuugaucuugccucacugcagccucaaccuccugggagcaagcgauccucccacgucagccuccugaguagcugggaauaugggcaugaaccaccauacccagcugauuuuuguggguuuuuuuuuuuuuuguagagacgggguuuugccauguugcccaggcuggucucaaacccuugagcucaagugauccacccaccuuggccucccaaagugcugggauugcaggcaugagcgaccacaccuggccccagauuuuuuuuuucuuuuuugauuucaugucccuugagucuuuuuuuuucucagauuuuaguauuaacaaguaauaauuagcaggaauaauauaaaaauaauucaguaguuuuacaaagcaagaacagagaugggcaguguaaauguggaaauguauggcacugguccuuauuucucaguaggggaaacagaccaaauggaccuaaaggcaguucccagggccacagaugcaguaucauugcugggguagguuccuuccauccaaguauccuaagucacucccuuucacaguaauuauuugcauguuuuaauaauuaaugguaaagauauuacuuauagauuuugugaaaggaaaauaaaucuagggaccccaaacucauuaagccaaagggaaaaguuaagcugggaacugggucacacaaaccugucccuuuugguuccuaaauaagauggcuacaagaugaaaagcuacaugcuuccgccauauuuugcccacaagcaaauucauagugagcuccaagaucuuuacccugagguuuuucugcuaaaauuuuaccauggcaauguaaauugauagcauauccuuacaggugcagucaccccccugcccaccagacaaaugcauaucugauuguucuccugccccauuuuguuuggguuaucuuauguaaaagugccgucucuacaaauaauaauaauaauaauaaucaaaaaauuagccaggcauaguggcacgugacuguagucccagcuacucaggaggcugagacaggaagaucacuuaagcccuggagguugagguuauaaugagccaugauggagccacuguacuccagcaugggugaaaaagcgagaggcugucucuaaaaaaauaaagugcagauucacugggccagacaaaggcgugaauuacuauuuucccuaaccccccuuacaugaaaauuguguacuucucaguaaccugcccuuuccccuuuaaauuuggagcccucaaaauuaucuucagagaaaggcguagaccugucucccgggcauauuuccuuaacuuuggcaaauaacccugcugggauuacaggcgugcacuaccaugcccggcuaauuuuuguauuuuuaguagagacaggguuucaccauguuggccaagcugcugucaaacuccuggccucaagugaucugcccgucuaggccucccaaagugcugggauuacaggcgugagccaccaugcccaaccucugcuucauguuucuuaagugaaucaauagagcaaaaucauuuucuaaaauccuacaagagauaugucagauuuugaagcagaaauuaucaaagcuuuacuuuccaggccccugcucuuuguccuuccuuucugcugaauccugcuguggccguuuuuauguugugcugguugagcuucagcacuucugaaacccuuugugguuguauucucauucagauccaucugcguucuuauucaguguggcucucagugaaucuucucaaauuuagcaaaaugcaucuuucacauuuuaggugcaucugcugcauuuuaaauuaaggccuucccucuucaucucaaauauccuuaauccuaaauaauucgacuuucuuuauaauuccuuuuagucuuuuauaugcauuauuuauaguaccuuacacauuuugcaguuuauaaccugcaaaugcccauagcucaguuuauuuauucccuggacuuugucaguuuuuaguuagcaaaaucaaaaauuaaguuuuauaauuauaucaaguuagugauuauuuuuucaccuguugaauucuuuuaucaugaauuauaggaaacgguuuacacgaaagucuaaugcuuaguaaauuguaucuuuugaaaugaaguuauaaaaugcauucccuguauuuuaagauuauuugccaauacuuagauuaaaauaguuugaccaauugaaauuaaaauuguuuuuaagguagucuaguauuggaaaaacaugaaacuuuauaggaaagaaggcagauuaauaaauuagcaguguuaggugagauggcuugggcuucucugcaagaguauuaaguuuaggugcugcauaauagcuuuguaaaguacuauucugucugaggacaaaaagcaugguggaaauaauagauaaaaauguuaauguuuggauagaguaacugauauucuguccucaguuauuguacauauuuguguacagugguauugugacuuaauuaauaaucauauaaugacuugauguuuuuguguuggcagaaaauaguaucuaaacuuuguauuacauuuacuuuauugacccuguaagaagagcccaaagaagccuaguguuugaggguucgcuuacuguugaauuguggcauuugaucacuuguaaaugacucagggggauuuuacuauugaaagauguuggcaccauuuuuuuccccucauucuuuuaacacuuuugcuauuccugaaaccugguagaaaaccauuaucucgaagaaaguguuaguuuucaagcgaaguauaagauaaagggcuucuuuguauguacauauucuuggaagaagggaauuauugccuuugaccuaaaaggaagaggcugaggcacaaaauauauuugaagaguuuacuugggccaaaguaaggacagcugccgagaagacucagacccaaguauccuugaauaugcacggucuuuguuacaaacagguuuuuugauuuuuuuuuucuuuucaggcaggaugugcucugucacccaggcuagugugcaguagcgugaucucaacucacugcaaccuccaucucccgggcucaagugauccugcagccucaacuuccugacuagcugggucaacaggugugcgccacuacgccuggcugauuuuucacuuuuuuguggagacaggguuuucaccauguggcccaggcuggucuugaacuccugaccucaagguguuccaaagugcugggauuguaggugugagccaccgccuguggccacuaaaauuuuuuuuuauagagucuugccuuuuugucuaggcuggaguacaccggugcaaucauggcuuacuacagcaucagccuccugcuuuggcauccugaugugugccaccauguccgucuuuuuuuuuuuuugaaacagaguuucacucuugucgcccaggcuggagugcagugguacgaucucggcucacugcagucuccgccucccaggugcaagcaauucuccugccucagccuccagaguagcugggauuacaggcgccugccaccacacccagcuaauuaguagagacgggguuucaccauguuggccaggcuggucucaaacuccugaccucuggugaucugccugccucagccucccaaagugcugggauuacaggcgcgagucacugugcuuggccuuuuuguuuuuuuuuaaagauagggucucacucugguugcccaggguagaguacagugaugugaucuuggcucacugcagccuggcccucccgggcucaggugauucuuucaccucaaccuccugaguagcugggacuacagcugugugccaccacaccuggcuaauuuuuuguguuuuuaguagaggugggguuuuacuguguuacccaggcugguuucgaacuccugggcuuaagcaauccgcugaccucagccucccagagggcuggaauuacaggugugagccacuucaccuggccauaauuuuuaauuuuuuuuuuuuguagagacauggucucacuauguugcccaggcuggucuugaacuccugagcucaagugauccuccuaccucacuguaggagguaaagccugccaaagugcuggaauuacaggugugagccacugcgccuggcauaaaucaugauuuuuaaaagcaaauaauauuucaucagaaugaaaagaguuaauauaauuuuaauggccauugcauuaaggccaacuuuguugaaugacccaugcacuggagauaagacccuggccaaugcuggagagaaacuaggcugauuuugucacucugugccugccuucuaacgcugaagaucauucugugauucaguaauaacaguguuuuuucuuagaauaacuaaaaaugcuucaguagaggaacugaaccauaagaaaugaguuuuggcucaauuuuaguuuaaauaguagucauuaaucuaacauagaaugacaguaaaugcagugagagaaagagugggaaaaguuauuuuauuuuauuuuauuuauuuauguaauuuuuugaggcagagucuugcgcuaucacugucacccacgcuggagugaguggcacgaucuuggcuuacuauaagcccugccucccagguucaugccauucauucuccugccucagccuccugaguagcugggacuacaggcgcccgccaccaugccuggcuaauuuuuuguauuuucaguagagacagguuucaccuuguuagccaggauggucuugaucuccugaccucgugauccgcccgccuuggccucccaaagugcugggauuacaggcgugagcuacugcacccggccaaaaaacuguuuuagauucaagaaaaauguuauauguuuuaauuuuauagauaaguaaauugacuacauaauuuauauaacuucagagauacuugccucacuaacugaugguuaauauggggauauuaagauauuuauuaaagcagugcuucucaaaguuuaauguauacacuuaucacuuggcagucuuaacuacaauucagagucccauucugcagaucuaaaggugagguucugguuucauuuguaacaaguuccuaggugacaccaauguugcuggucccagaccauacuuugaguagcaagguaccgucacuuugauauggccauuuaguuaguugaauugaacucuguagacuaaagauuaaacaggacggauugaccacaugcaauguucuuuuucccccacucuguagaugggcuuacugcuuauuagaaugugcugcauuuauggacucagugugaugucccacucccuccuaugaacuuucucagggagcaugaugacacggccucacccacuguuucccacccagauugcucaucugugaugauucuuuuuuuuuuuuuuuuuuuugaggcagaauuucacucuuguccaggcuggagugcaguggcacgaucucggcucacugcaaccuccgccucccagguucaagugauucuucugcuucagccucccgaguagcugggauuacuggcauaugcgccaccacacucggcuaguacuguauuuuuaguagagacaggguuucaccauguuggccaugcuggucucgaacuccugaccucaggugauccacccaacuuggccucccaaagugcugggauuauaggugugagccaccgugccuggccaacuuuucuuagcuuucaucacaagcaaaaucccauguggccuguccucuguccauguguguagucuuauuugcaagguauuugccucucauucacagaggcguucaguuuuaaauuuguuugggaguuugauuaaugucucuacagauuaaguaagcucuuuagaagcagagacgaugucuguuugguucaccauugugucccuagugucugguagaaugucuaccuagugguagaaucacagaaauauuuguuggauaaaucaaugcugggcacagagugagcaguccacaaauaucguucuuucuugacuaguuaaguauguaaaucauguauuaauacuuguuaaaugaccaaggucaggggcguuuuguauuuuuaauugauauaguuguacauauuuaggugguacaugugauauuuugauaugcauauacaauguauaaugaucacgucagguaauugcaauauccaucaccucaaccauuuauccuguuuuuguguuggguacauuacaguucuuccaacuguuuugaaauaaacaauaaauuacuguuaacuauaauuuuccuacuauacuguugaauaccagaauuuauuccuucuaacuguauuuuuguauccauuaaccaacuucucuucaccaaaccccacacugauguuugaauugcuucuuuuugcucuaguugacuauuaaaaacaaauaauagaaccaaccaaaaaaccgccuguuaacaaaguagaaagacagacacagcuuugaucagcuuacaaaaaauaggugucagcagguaugaaaaucaguguuaauugguuauuauggcuuuauuuugaaugauuucuuuguuuuacuuuuaugauaguuuaacacauacaaugaaauauaacaugucuuuaggcuugugucaucuguuuuuaaaaauuaauagacuugaguuuuuacaucaguuuuagguuuacagaaaaauugagcagauaguacagagauuccauacuucauaccucucuccugccuucagucuucccuauuauuaacauuuugcauuggugugguacauuuguuauaauuuaugaaccaguauccauagauuauugaguaauccauaguuuauauuaaaauuaauuuuuuguacaguucuggguuuguuuuccuuuuuuauaaaauguagaacccuagaguuucuauguuuugacaaaugcauaauguccugcuguccuguguacaccauuauaauauacaaaauaguuuaacugcucugaaaauccccugggccccaucuguugauuggagugcuccaucuguucauuggagugcuccaucucuccuagccucuggcaaccaguggucuuuuuacucucuguaguuuggcauuuccaggauguuauguaguuggaaucauauauagccuuuucagauuaguuguuucaguuagcaauauacauauaagguguuccauaucuuuuugcagcuugauaguucauuucuuuucccuuuuaaaaaauauuuauuuuuuauacagaugggaucucccuguguugcccaggcuggucucaaacucccagggucaagcaauccucuuaccuugcucucacaaagugcugggauuacaggccugggccacagugcccacccagcucauuucuuuuucuugccgaacauuucauuguauggauguacuacaauuugcuuauccauucaccuguugaaagacaucuugguugcauucauguuuugguaguuaaaauuaagcuucuauaaacuuuagugugcagguuuuuguguagauaaaaguuuccaacucauuuggauaaauauuaaugauccaugauuucuggauuaggugguaagguauguguaguuuuguaagaaacugucagagugggcuggacauaguggcccaugccuguaaugcaaacacuuugggagagacugaggugggaagauugaagccaggaguucaagaugagccugagcaacacagugagacccaucgcuacaaaaaauuuaaaaaauuagugggugugguggugcgcaccuguaguuucagcuccucaggaggcuacggugggaaaaucacuugagcccaggaguuccaggcugcagggaguuacgaaugugccacugcacuccagccugggcaagagugagauccugccugucuaucucucagucaucuaucaaaguaaauaaaaaauaagacuguuauggugucucccaauguagcuguacaguugcauuuccaucaacagugaaugaguucugguuguuccgcauccucuagcauuuucugaugucaggguuuuggauuuucacuauuuuaauagguauguauugguaucucauuuugauuuauaauucccuaaugcuaugugauguugagcaucuuuuuauuuauuuuuuauuuauuuauuuauuuauuucuugagauggcgucucgcucugucgcccaggcuggagugugauggcgugaucucggcucacugcaaccuccaccucccggguucaagcgauucuucugccucagccucccgaguagcugggacuacaggcgcccaccaccaugcccggcuaauuuuuuuauacuuuuaauagagacgggguuucaccauguuggccaggauggucucgaucucuugaccuuaugauccacccgccucggcuucccaaagugcugggauuacaggcgugagccaccgcgcccggugagcaucuuuucacaugcuuauuugucaucuguauauuuucaaugagauauuuugcccauuuguaaauuggaucuuuuuuuacuguugagcuucaggaguucuuuguauacuuuugguaacagucuuuuaucagauaugucuuuugcaaauguuuuuucuccaucuguagccugucuuuucauucuuaauagugucuuuugcagagcagaaguuaaaugaagucccacucaccaauuuuuuaauggauuguguuuuuggugucauaucuaaagucaaggccaaaggcaaggucagcuggauuuucuuccauguuaucuucuagaaguuuuauaguuuucaguuuuacauuuaauuccaugaucaauuuugaguuaauuuuugugaagagugcaaggucugugucuagauucuuuuuuaagacucuucuauugaauugucuuugcucucuguuaaaagaucauuuaacuguauuuguguggauuuauuuuuggacucuauucuguuccauuggucuacuugucuguucuuucacagauacccuacugucuugacuacuguagcuuuagagugucugaaagagguugaggagugucagaccuucaacauucuucaauauuguguuagcuauucugagucuuuucaccucuguauaaacuuuagaauuuauuuuuugauacccacaaaauaacuugcagagauuuugauuaggauugcauugaauuuauagaucaaguuaggaagaacuaauaccuuguuaguauugagucuuccuaugcauacacauggaauauuuccuuagaucuacuuugauuuccuuugucagaguuuuauagcuuucuuguuaaagaucuuguacauauauuguuagauuuauaccuaauuuuuggugugcuaauagaaauaacauuuggaauuuuuuuugaaauuaauguauuuuauuuuuuauuuauuuuuuuuuuuagagacaggguauugcccugucaccuaggcuggagugcaguggcgcaaucauagcucacugcaaccuugaacuccuagguucaaggauuccugccucagccucugcaguagcuaggacugcaggcaugugcuaccguguccagcuaauuaaaaaauuuuuuuuuguauacaugauguccuacuauguugcccaggugggucuugaacuccugggcugaagugauucuccugccucugccucccagaggggugagauugccagacaugaaccacugcaccuggccuggaggaguguguggguguguguacgugaguucauuuucuacauggacaaauaggucaucugcaagcagagacaguuuuacugcuucccagucuacacauuuuaaauuuccuuuucuuuuguuauugcauuaauuaggacuuucaguacuauguuaaauaggaguaguaaaggggacauccuugcuuuuugccucaucauagugggaacaccauuaaauauaaaugcauauauaaaaauuuauauguuuauauaaaauauauauuuacauaaauauuuaaaauauauauuuacauaaauauuuaaaauauauauuuacauaaauauuuaaaauguauauuuacauaaauauuuacauaaaauauauauuuacauaaauauuuaaaauauauauuuacauaaauauuuaaaauauauauuuacauaaauauuuaaaauguauauuuacauaaauauuuacauaaaauauauauuuacauaaauauuuaaaauauauauuuacauaaauauuuaaaauguauauuuacauaaauauuuaaaauguauauuuacauaaauauuuaaaauguauauuuacauaaauguuuauauaaaauauauuuacauaaauauuuauauaaaauauauauuuacauaaauauaaaauauauuuauauuaauauauuuauauauuauauauuuauuauuauaaauauauauacaccauaaauacuuucucaccauuaaauauguuagcucaagguuuuuuuuuaucaaggugaaggagguuuuccauuccuaguuugcugagaguuuuaucaugaauugaguguuggauuuugugaaaugcauuuucugcaucuguugauaugaucaugugauuuuucuuguuuagccuguuuuuguaguagaugacaauugauuauugacuguugagcuagccuuuuguauacuuggaauaaaucacauucaguuaugguauauaauucuuuuuacauugguuggauuugcuaaauauuuuguggaggauuuuugugucugugcuaaugggagaugucagucuguaguuuuuuuaagacagggccuugcuguguugcccaggcuggagggcaguggcaugaucaggacucacugcagccuugacuucacagggucaagcaagucucccaccacaccuggcuauuuuuuuuuuuuuuuaaauuuuaguagagagagucucgcuauguugcucaggcuggccuugaauuccugagcucaagugauucuccucccuaggcuuuccaaagugcugggguuacaggugcaauccaucaugcucagccuguaguuuuucuuucuuguaguguuugucuguuuuugcuguuaggcuaaaccuggccucacaaaacgaguuaggaaguauucccucuacuucuauuuucuagaagauauuugagagaacugguauaauuucuuucuuaaauaucugguagaauucaccuaugaaccuaucugggccugaugcauucuguuuuggaaggguauaguuauugauucaaucacuugcauggauauaggucuguucagauuaccuguuguuucuacugaauuuuuuuguacauuugugucucauuuucuuuuacucaccguuaugcuaacgaggauguugugacugaggaguguuaaaaucaccaacucugucaacuuucuuccuucuuuuuaaaaauucuuuccauuauaacuuaauguacuuugaaguuccauuauuagguauguacacauaugauuguugugucuuccugaugaauugacucuuucguguuuauaaaauguucugggcugggcgcaguggcucacgccuguaauccuaagugcuuugggaggccgaggcaggcggauuaucugagcucaggaguucaagaccauccagggggcaacauggugaaacucugucucuacuaaaauacaaaaaaauuagccaggcuugguggugcacaccuguaaucccagcuacuugggaggcugaggcaggagaauugcuugaacccgggagguggagguugcagugagcugagaucacaccacugcacuccagccugugucauagagugagauucugucuuuaaaaaaaaaaaaaaaaagaaguucugcauuaucuccaguaauacucuauaucuuacagucuaucuacucuuugauauuaaaauagucccuccaggcuucuuaugcuuuacuguuugcuuucaacuuauuugugucuuuguuuucaauauuuaucucuucuaggcaacauauaauuguggcuuccuuuuauauccauuccaacaacucuaccuuuaaauuaaagaguuuaguccauuuauauuucauauaauucuugacaagguuggauuuaggucuauuuguuuucuguuuauaucuucuguuuugguuuccuuuuuuuucuuuucuuuuuuuugacauagagguauguauaugaaaauagcguguaguuuuuacuucuuuuuucuccucuucuuuuccugauuucuuuuggguuaauuuaauaacuugaauauauuggggcuuauagcauaccuucuuaaauuauuauucuuuuagugguugccauagggauuaaaccauacuuggaguuaauauuguaccacuucaucucuuuuuaagagacagggcuuuguucuuucucccagguuagagugcaguggcucagucauagcucacugcagccucaaacucgugaguucaagugauucucgugccucagcuucccgaguagcugggauugcaggugugugcugccaugcuuggcuaauuuuuguauuucuaguagugagacaggguuuugccauguuggccaggcuggucucaaacucccaaccucaagugauccaccugccucggccucccaaagugcugggauuacaggcacgagccacugcacccagcccaucuuauacuuaagaacccauaugugucuguauagauucaucucuaacccuguucuuuaugcuuuagguuucauauuuauuauagucagauacauuauaaacuucaguacagucguaugauuuuugcuuugaacacuccuguguauuuuauagaaauuaagaggaaaaauagucuauuuuccuacuaauaucauuuccagcaaucuuuauuccuuuaugaaaaucuaaguuuccauguguaucauuuuccuucaaucugaacacauuuuaaagaacauuucuuaugguguccaucugcuggugaugaguucucuuuuaauuuaacuguuuauuuuuucuuuguucaggagggauauuugcuuggaaauggaauucuggguugacagauguuuuguuguguuuuguuuauuccucaucuguucucuauuguuucuaguuuguagucagcauucauagguguacuuguuccuccuauguuauuuuucucuagcuguuuucaggaauuucucuuuuauuuuugaguuccaguaguuugacuauaauaugauaaaccuacuuguggguaacugcauuuaucugcuuggagcuauuagagcuucuugcauguguagauuuaugucuuucgccaaauuugggauuuuucuuguaauauuuuguucugaaucauuuucucuucuccucuggaacuucaguucaauauauguuaagaccuuuuggccagguacaauggcguacgccuauaauccuaacacuuugggaggcugaggcacuaggauugcuugaauccaagaguucgagaccagccuaagcaauauagugagaccucaucucggguugugggggaagaccuuuuaauauugccccaugagucccugaggcuuucuuuuuuguuuuuuuuucuuuuuucuuuuugagauggagucucgcucuguugcccauccuggagugcaauggcgcuaucucggcucacugcaagcuccgccucccggguucaugccauucuucugccucagccucccgaguagcugggacuacaggugcccgccaccaugccuggcuaauuuuuguauuuuuaguagagaugggguuucaccauguuaaccaggauggucuccaucuccugaccucgugaucugcccgccuugaccucccuaagugcugggauuacaggagugaaccaccacacccagcacuuucuuuuuuuucuauaagauuggauaauuuaucuuuaucuucaaguucauugacuguuauuagaaccauacucuauacccauacagcgaauuuucuauccuagaauuaguuucuauuuuuugagauuuccuguuuauucuuguugaguguauuucuuuuauguccaauuagcguuauaauagcugcuuugaaauauuugucuguuaaauccauaucuguuucaucuuaugauuggucuucauugauugcuuuuuuuaaaaauaguguuuuuuuuuguuuguuuguuuguuuuuaauugagacagaguugcucugucacccaggcuguagugcaguggcaugaucucagcucauugcaaccucugccuccuggguucaagugauucuccugccucagccuccccaguagcugggacuguaggugugcuccuccacaccuggcuaauuuuuguauuuucaguagaaacuguuucaccauguugccaaggcuggucucgaacuccugaccucaagugaucugccugccuuugccucccaaagugcugggauuauaggcuugauccaccgcaccugccccauugauugcuuuuugaugacugaguuuuguuuuccuauuucuuuguuggucuguuaaucuuggauuauauaauagacauugugaaugauaaauuguagagccucuggauucuguuauguucccucagaguguugauuuuuacagucuugucuucagcagucaaguugauuggauucagaugucaaacucuaccuccuucacggaaggcagcagaugaaauauuuauuguuuuguuuuaucuggauuguuuaguaccuguccugugcauguauaguuccagugaucagccagaaauuugaguagaguuuauauaugaauuuggacuuucuucuucuuaggcugucucccuuucaucacuguucucuggcuuucuagcugcugugguuguccugaacucuauccucagauucuucaagccagcaagccaacaagacuguggguuucugaggguuuuuuuuuuuuuuuuuuggagauggagucuugcucuguugcccaccaggcuggagugcaguggcgcgaucucagcucacugcaagcuccgccucccagguucacaccauccuccugccucagccucccgagcagcugggacuacaggugcccgccaccacgccuggcuaauuuuuuuguauuuuuaguagagacgggguuucaccauguuagccaggauguugucgaucuccugaccucgugauccacccaucuuggccucccacagugcugggauuacaggcgugagccaccgugccuggcaaggguuucugaguuuuuagucauaccucuccccuucuuuuggcauccacuggggcacacccucaggcugaaaggcaugaauaaaccgucuagagcccucccugcuuccaagguauuguugaugucccuuccauuuuauagcuauuuuggucacucuguagugccuacaggcaguuguuuugugauauuuugccccacgguuuguuguuguuaucaguggcaaaaguugcucugauagaacugcuuagcuaauacuagagaagucaaaauucuccauauuaguuuuaacaguagccuuaaaaaaacagaaugauagcuaauauuuguuuggcacuuuuuuuguuauaaaagcacuuuaauguagauugucugauuuaucaugauuguuaauaauacagugcugcuacauguugugccaaaaauaugaacaggaaaugagucugaagucucaauucagcaugauuacacauaugaacugauacaacaacuaaaaugaaaauaaguggggagaaagauaguaguggaaacuauagguaugaaaaggaauagaagaauuuugugccuuuggggaggugauacugccagcagguaaauggaguccauguaugcauauauaaauuacugucuucuguauuaguucuuuucauuuguuauuuuuauguauuuacuugccuuuugagauggagucucacucugucacccaggcuggagugcaaugguacagucuuggcucacugcaaccucugccuacccgguucaagugauucuccugccucagccucccaaggagcugggauuaugggugugugccaccacgccuggcugauuuuuguaauuuuaguagaggugggguuucaccauguuggccaagacugcucucaaacuccugaccucaagugaucugccugccucggccucccaaagugcugggaguacaggcaugagccacugugccuggcugcuuuuuguuuuguuuguucuuuuuuuugagacaaggucucacuucgucaccuaggcugcaguucuguggcacaaucacagcucacugcagacccguccuccugggcucaauucucaugccucagccucccauagcugggacuaucagcuaauuuuuacauuuuuucucccaagaaaucuugccuaagauuaaauuauuguuuuuuugagacgagucucacucugucgccaggcuggaguucaguggcgugaucucggcucacugcaaccucugccucccggguucaauugauucuccugccucagccucccgaguggcugggacuacaggugcacgccacuacacccagcuaauuuuuguauuuuuaguagagacgggguuucaccauguuggccaggaucauuucaauuacuggaccuugugauccaccccccacggccucccaaagugcuaggauuacaggcuucagccaccaugccuggccgauuauuguuuuuauacauacaaggucucacuacauugcccaggccugccucaaacucuuggccucaagcaauccucuuacuuuggccuuccaaaguguugggauuacaggcaugagccacugcaccuggccucauucuuuuauaaaacuuuuauuuauaauuuuaauaauauuuaucacaguuugaaauucuuugucucuaaaagaaccauggggaaaagaauaauuuuuuauaaaauuuaaauuauuuaaaaauuguuuucuguuuauucacuacacuguaagcugugaggaccaggaccauguuuuuguauguccagcucguaggccagugccugacaugauuuugaaggaggugacagguagaaauugaagaaauuuauuggaaauguuccagauuuggaugguuuucauucuacuagauagcagaaaauuuuuugggcuggguccaguggcucacgccuguaaucuuagcacuuugggaggccgaggcggguggcugucuugagccaaggaguucaagaccagccugggcaacauggugagaccccgucucuacaaaaaaaaaaaaauauauacaauaacuagccaggugugguggugugugccuguagucccagcuacuugggaggcuaaugcaggagaaucacuucagcccaggagguggagguugcagcaagcugagaucgcaccauugcacuccagccugggugacaggagugaaacccugucucaaaaacaaaaaaaaaaggaaaauaaaaaaugggaaguguuaaggcuaagcucaauacuuugagccucaaaagaaauauucaggccauggucuugaguagugagacaccagaaguauggagauagugaugaaaagcagucaaugcuuuucauucccucuugcuucuguguuuuaggguuccgagguccuggcaugauagggagaguucaaagcaaguauuuauagguuauuagaauugauuuucuuaguugugaaacugucuuguuccacagcucuuggauaagcacaagaauacagagagcaugguggagcuucuggacuuguaucagauggaggaugaagccuacagcagccuugcagaagcuacaaccgaacucuaucaguauuuacuacagccauuccgagacaugagagaacuugccaugcuacgaagacagcagaucaagguauuuuuuuauuaauccuaacuaguagccugccuguuucauaguucucagccugaaaggccaugcguuauccacaagaggaacuuuaaaaaaaaaaaaaaaaagaagguaccugguccuauuucugcaaaguuucuuguuugguagaauaggguuguagccugaguauccauucuaaagcaccucaaaaggcaauucugcugaguagccaggguugaggauagcccagaaaguaauguguucaaguuagcacaaaguuguaaauacauugggaggauuccuauuuucucccuuuccugcacuuuccuuccuccucuagucaugucuccucuuuaauguuuuggagacuguguacucuuagacuucauuaccagaaauuuugggcaggcugagcguggugccucacacccguagucucaacauuuugggaugcugaggcaagaggaucacuugagcuccgagcuugagaccagccugggcaacacggagaacccgucucuacaaaaaaaaaaaaaaaaaaaaaaaaaaaaucaaacuagcuggaugugguggcacaugccuauagucucagcuacuuaggaggcugagguaggcggaagauugcuugaacccaggaggucauggcugcaaugagccaugauugugccacugcacuccagccuaggcaacaccuugucuccaagaagaagaaaaaguuuugggaacauuucuuuuuuuuuuuuuuuuuucgagaugggaucucgccauguugcccaggcuggucuggaacuccugggcucaagcgauuugcccaccucggccucccgaaguucugggacuacaggugugugaaccaccaugcccagccaguuuugggaacauuuguuuuagaagaacuuguuaggaaaguuuuaaguuuuuaaugacagaacuuuaaauacaugaaauuuuuuauuagugugugacaaaguauauuacaaaaaauuuuuuucagccaggcauggaucaugccuguaaucccagcacuuugggaggcugaggcagguggaucaccugaggucaggaguucaagaccagccuagucaacauggugaaaacccaucucuacuaaaaauacaaaaauuagcugagcaugguagugcaugccuguagucccagcuacucgaagggcugaggcaggagaaucacuuuaaccugggagguggagguugcagugagccgagauugcaccacugcacuccagccugggcgacacagcaagacucugucucaaaaauaaaauuaaauuuuuucccccacaacaugggugaaaaagcauuuuuugaggcaagcauuuaaggguuugauuuuauagcugaccuuaaauguuauguguaauucauauauaaauguugcugaacuagaacauuaaaauugucuuuuuaccuaauagguuaaguuggaauaucauuauguaagauugaguauuugagaaaauuagcaauuacuuugagaaccuuaugcguggggacaggggugaguauauuugaaaagguaugagaaaguaagguugucugugugucuuauuuucucuuuacuaacguaucaggguggagaguaggacagucacacgacuuagacauacuccuuuaucaauacuuuuggaaaauagcugugcugucagcuuuuugagggggggauuuguuuuggucagucaguuuuaucauaaauuuggcauuuggguuaaaacagcaacauggaacaaauaauuuuuagauguuggaaauuccugguuuuuuuuguuuuguuuuguuuuguuuuuuugagacagcgucuuugucaccugggcuggaguacaguggcaugaucucagcucacugcagucucgauguccuggguucaagcagucuucccaccucagccccacaaguagcugggacuaugggcgcaugccaccacgcccagcuguuuuuugucguaguuuuugugcggaggucuccaucuguugcccaggcugguccagaacucuugaacuccagcaaucugcccaccuugauugcccaaagugcugggauuauaggcaugagccacugcccagccuggaaauuccuguuucuuuaaaugaaucauggauauuugucugcuaagaacuugacuagaaggccaggaauaaacuggacgaccuggauacccaccuacuuuagacugcugcauuguuuagcagacauaaucucuauagcacagcacugacuauccagaaucuguacacauucuuuuacauaauuauaucaugauuuguauuggguauuaauauuagcaaauugguugacccuacuugucagccuauauuguccacuagcaucacuuaacugcuacauuuuuccugggaaguagaauguaggugaagaggaacagaaaacauauuuugaaaauuugugucuuuucugacaguaaaaaugguauuucacugcauuucuuuuucuaagacauugagaaaaugccccaucaaucaugacuauucuuuuauucuugauccuacuugugaauuugcagauauaaguuuuuguuagccaacaacuagauuuaguuagcaacucauacauuacauuagauugaguguguuguauugcuuuaaaaagauccgcuaauuuaauuaucacacaaccuuguaaguuggguacucuuauuauuuguauuuuccuacuucauagauaagaaaacuaauauugggauaauuauguacuuguucacagcuaauuuguaagugguagaacugauacaguacucaaaucaggcauuucugauuccaaagauuuuuuuuuuuuaacugcauuacugguuacuuguuacuucuaaguuaaaaaaucuacucagacuuuuuaaaucuggaggagcuaaaaaaaaaaaagcaaguauaauugauuagcaaaguaguuguuuuaaguauuacuaagauguauuaguaauagaaaaaaagaaaauaauuuauuuuuauuuuuauuuuuauuuauuuauuuuuuugagacagagucucgcucuguugcccaggcuggagugcaguggcgcgauuuuggcucacugcaagcuccgccucccggguucgugccauucuccugccucagcuucccgaguagcugggacuacaggcaccugccaccacacccggcuaauuuuuuguauuuuuaguagagacgggguuucacuguguuggccaggauggucucgaucuccugaccucgugauccacccaccucggccucccaaagugcugggauuacaggcgugagucacugugcccagccaagaaauuaauuuuuuuuuuuuuuuuuuuuuuuuuuacuuuuaaaaccuuuuuguuaaaaacuggagcacaaucacacaucuagggccuacccaggaucaggaucaucgagaugucacuaggccaaucaaacagauuuuucagcuccaauauaauuuuaucaaaccccuauuguauauguguuucauuguugacugaaacaucauuacgcagcacgugacuauaauagaauaauuuuuggcaaugcaaaggaaugaacugauggacacagcauggguaaaucuuaaaaucaugcuaagucaaagaagccaaauacaaaagaauauauaaugcauaaagggggauggacuuaaaaggggcacgaagaaucuuuuggaguugauggaaauggucaguauuugauuaauguuguuucagagguguauacagcugucaaaacucauugaguugaccacucuaaauggauucacuugguuguauauaaauuaagccauaguaaaauugcuuacaggaaauaugcugaggaaaagacaucuaacacaaagagcauaaacuuugugauaccuuuauuugaaauucuaggccagguguaguggcucaugccuguaaucccagcacuuugggaggccgaggcgggcggaucacaaggucaggagauggagaccacacuggcuaacacggugaaacccugucucuacuaaaaauacaaaaaaaauuggccgggcauggugguggccaccuguagucccagcuacuugggaggcugaggugggagaaugacaugaaccugggagguggagcuugcagugagccgagaucaugccacugcauuccaaccugggugacagagcgagacacugucucaaaaaauaaaaaaaaaauaagaaauucuagaaaugaugauuuugaucuguacuaacagaaagcuaaauaauuguugccuuggguggcuuaggggaaauugacagggagcaagcaccacagacaacuuuggagugauucuuuaaaucuagauuuuagugauaaaaaugaauguacacauuugucaaaaucaaucacaauuuacauucaaaauguugccuuuuguaggcaaguuauaucucaauaaacgugauuuuuuaaaaaaaguuaaaugugaagaauguacacacuuauauaagaagcacacaaaauggggugaucagugccuaaagauauaugugaaaagagggacuaucuagugcuucacuauugaagaaugaauaagaauuuucaguaggaaguggguacguuacaaucucugucagagauuggaauagagaauauuccugaugaagagauguacaaagaggaaugguuuagugcuuauacuuagugcuugugcuuuaaccagguaaugugguauuggcacuaacuuaauugaaucuucacaccaauccagcaccauugaugguugccagaaaguagcgugguugggauugaacacguguuugauagcaaaaccugcuguuauccacagggugugaauuguuugguaugcuuuuagucuaaggauuuauagaagaugagaggaaagaugguuggaauguuauuauauucuauggacaguugugucuguuggguucuaaucaaaauaucaaaccgguuauuucaacagagaaugauaauaauaauaauaauuauuauuauuuugagacggaguuucacucuuguugcccaggcuggagugcaguggugcagucucaccgcaaccucugcuucccggguucaagcaauucuccugccucagccucccggaguagcugggauuacaggcaugugccgcaaugccuggcuaauuuuguauuuuuuaguagagggggguuuccuccauguuaggcuggucuugaacucccgaccucaggugauccacccgccucugccucccaaagugcugggauuacaggugugagccacugcacccagccgucaacagagagaauuuaauauaaagaauuuguuaacuagguauaaaguaguuaaccaaauaauugaccuuuucucuuuaugaagagcuugauuuccaaugguuucauuaaccuagguauuaaaguaugauaggaaagaagagaacuuggcaucccaaauguauaauguauuuauauuuguuuuuacauuuaauauuuaugauauuaacauaauaucucaccuguuaaguauuaagcagcuccugccuacccagcauuauuuuaggccaggaagucuuucugagauagacaccccuuuagggagcucacagauucuaagucuacuacauugggucucaaaaaugugaucaccugacuaguaguaucaguauaaccuggaauccuguagaaauacagauucuugggcuucaccucagaucuucucuacugaaacucuaggaauggaccucagcaaucuuuguuuugacaagcuuuccaggugauuaugauacacacuuaaguuugagaaccacuagccuaauaaaacaggacuugaaacagcuuagggauuucacauacugaacugaagguuacaauuuuucugggucugaguuuuucugggucuuaccaaauugacugcaguauuaaaucuacaaaacuucaaaagucaguuagaaacagcauuaaaaagugcaaaaagcguguuuguauucuuuguauuuguagcuauaaacacauuuugaagguaaagauauuaauccaacagcaagguacaaauuacuuucuuuuuuuuauuuuuuuauuuuauuuuuauuuuuuuucacaaauagcacuuuuuauuugccacuauuugaagucugaacuuuaaacagauucuuggacuggugguucaaaaccaucagcucguucaacuuuagcaccucucucguccccaguggcuuuuccagaacuacugccuucaccaugaagcuccaugagcuuucccaauucaaacuugggcuucuucagcauuuuuacuuuucuaacgaagacaucauggagaggauagauuggcaagccuuuucuaugucuuuuccaaugcugucuggaaucaauuuauugaccacuucuuucaaggcauuugucugcaccucucgggucaugauuuccaucaucuucuuccggauuuggcggacccguuggugcugggcauaagaggucuucuguaucugauuguugcguuuuuuaguaaaaccaacacagaacagacgaagcaaguaaccaucaauaguccugacgucaacgugagcuucaaucauugucugccauuuuuugaccauggaacacauuuugucacagguaagauccaugccauggaaguuaggcaguuuuuacccugaacaucuucaguaaucagcuugaauuuucuaagugcaacuucaucauucugcaaaucagcaagacucacuucaaacacacgacccuugagaccaucagaugcaauuuugguuccuuggguccuggugaugagcaucuuuccaauauuucuuauauugaacauagcaggugcuuucacaucauaccaaucuuucuuagaaaauggaucaaccacuuucuucuuggcccccuuuuugcugccuuucguaaggugcuuguucuugccaaccgccauggugcuggucagagagccaaaaggaaguuacuuucaaaugaaaguaaaaugaaguugaaacuagacgaaccucuagauuuuuaaauccagugucuuuaaugagucagagccagcuggacuauacucaucaucuugaucaaccauaagcacuucagacagauuguccaacuuauuuuuaaauacuuccugaaaguaaauaagcuagaaacuggaaggcacuugcauuucuuucuguuguagccagucaccucauuuugccaguugucuccuaguaaauucuugaaugugcauuucauucuuaucccaacccccagggcaagucuguaggugccuuucugugaaauagaaaacugcacccccugccccccacccgcccacugccagucacccaucaaacaaauuaggaaagagcccuuuuucaucaaguguagaaauacacauggccuggcaaagcaugggcugcauuucaguaucuacuccauccccuuggcugggugcuauuuauugugcagggugcaguuuuuaccacuguaugcauccaccgcaugcacacugugaacuagguagugccaccauuauacauuaagauacucauaucucaccugagcuauacuuuccuuuaguucacuugaguuucgauuucucucuuuuuuuuuuuuuaagcauaguuucucacacuuggcuuagcuauaagaaucucucaacaauauuugcucugaauauaaaaacccaugaauagauacuaagcuaaucauguuguuagaucauucaagagucaucuucaggcaacuccagggucuggaauauuugcauugugggugcuguuacauuaguauauucacaguuuuuucccccucaucuucuucaugaugguacauucacagauuuaucuuggcauuguuuuaccaaagaaucuaagguggauuuccccccuacuguguuucuuacauaaaagccaguauccaagugcugugcuucauaauaauuccacgucagguaauuuguauuuauaaacuaguuucgcuauccuagcugacacgcgcuuuuuuuccguguuaaaaacaggcacuguuuucuuucuagcacugaaauugaaaacagaggugucauuguuuuuagcacaugauccaucuaaccagugcugcacaucuucaaauuugccaaguuaggaaaaguacuuaguacccuuguuuaaugucuuagguacaauaaacuauuaaacaaguugcuuacgaguuggcugcaacauuaaagcuacgaaacuucaaaaaucaguuaaaagacagcauuaaaaagcauagaaagcauguuuauguucuuuguauuuguagcuguacucauaaagguaaagacauuaauccacaacaaaguacaaguuacuuucaaauaacuugccacagguuaaaaaaaaauuuuuuuugccucuucaaaaagccucaaggcugggcgcaguggcucacaccuguaaucccagcacuucgagaggccgaggugggcaaaucaccugaggucaggaguucaagaccagccuggccaacgucgugaaaccccaucucuacuaaaaauaaaaauaaauuagccgggugugguggcgugcucgugcaaucccaacuacucaggaagcugaggcaggagacuugcuugagaccgggaguuggagguugcagugagcugagauugcaccacugcacuccagugugggugacagagcaagacuccauaaaaaaaaaaaaaaauccauaaugcaaguuuuacacuuuucuuucgauaaaugguacauggacuuaaccaugcaaguaagaaugauuuuuguauuaagauuuuugaauucugaacacuauuaaauuucuguuccauaguuguaucuguugagagcuaaucagaaaaacuaguuauuucaacagagagaaucuaauauaaagaauuuguuaauuagguauaaaguuguuaaccagauaauugagaaggcaagaaaguaacucuaagguacuuccagaggaagcaauuguaaaaacagcuaccacuccuaggguuggagaaacaaagagaagggauuggaauuauuaaaacugaagcauagaggaggaaccccguggagcugaccugaaaaagagggcauugcuugccuggugcucaauggagagaccuaguucucagaggauucaguacugagggguugguuugucuuggggguuguacuaugagccuaggguugaaaaaacugcaaauuagauuccguuacugcuucagaaaggaacugccgaugcuggggugaaauaaggcuugggugaugcugacaggaacagccaccaguugaagucaagggaugcagauagaagcauaucuccucccucuuccaaacucuucuauuggcaaaggcuaaaugugauuugcacucucaaaccuagcaucacaagacagaaggaugaacuuggagaugaauagacaagaauguacacacaucuucagacuuucaaaguuagggggaacuagcuuaagguuuuagguacaaucgacuaauuacggaucuuuaaccuuuggacagauguuacagcugcugaguuuuaaaagucaguuaaaggcugggcaugguggugugcacuuguagugucagcuugcugggagacugaggcaggaggacacuugaggcugagaguuugaggcugcagugcgcuaaugauugugccugugacuagccccugcacuccagccugggcaacauagugagacccccaucucuaaagaaaagaaaaauuuaaagucaguuaaacagcagcuuaaaagaaaagcauacugggcauucgaguauuucaccuucuguauauuugaauauauuaagguagcaaacuauguuaucuucacauaauugucaaaggauuuagacuuuucaaaaaagguauaacuucacuaauuuccauuugucuuuucuuuguauuguuaaauaaaguguaaucaugucauugagaagaacuucuauuauaauauccugaguaagggauuuaaguuuugacuuguaucauuauuaaauuucuaucccauacuuguaaauacuaauuguaugcuuuuaaaccuguauguuuuaaauucagagguaauugcaauaaaagaaagcacacauaccaauuuucuuauagcaaacaacuccaccagaauccuuaaaucuaagaugaagucuaaauaugucacuuagugcauagaaucccacagugguuuccugucaaauuaaauacacgguccuuagccugacauuuuaaaugucuuuuaagacaaccucauaugauaacaaccuacuuuccuaguaucucucauuacuuucauuuuucucuccugaaagcaagcaggcuggacugcuuuccaucccuuagcaggcacaaaaauuuuuaggcuuuugcucagauugcuccucaccucucgcaugccuuuucagugguuuuucucucuuuauguacccgucaaaauccuaccccuucuucaaagccaucugcaguuaaugaaccucaaugaaguuuguccucaucuacacaaaugauacucuuuccccacaauaccuuuuauuuuucucauagguguuuuacccagagacacacuuaaccaucuuuaguaucuggcuaaaauucuguuaauauaaaauucuacucuuaauauuuccagauauuacucauuauucccuuucgaaagucugcccagacuuugcacccagauuucuacaccugaugcuccccuugaugucuuaggcaugcucacucaugacuuuuuuuuuuguuuuuuugguauucuaauucuuuuuguuuuguuuuguuuuuuuuuguuuguuuguuuguuuguuuuuaguagagauggggucuugcuaugguacccacgcuggucucccaacuccuggucacaagcaauccucccugucugucugggagcaaaaggaaagcaguuuuugcgugacucagcucccaagcuuaucuugcccuuugauauagugaguuuggggucuugagauuuuauuuuccuuucacagcauuguuuagagacuauggguuguaggccaggugugguggcucaagccuguaaucccagcacuuugggaggcuguggcggucggaucauuugaggucaggaguucgagaccaggcuggccaacaugacaaaaccccaucuauaauaaaaauacaaaaauuagccgagugugguggcgggcaucuguaaucccagcuacucaggaggcugaggcaggagaaucacuugaaccugggaggcggagguugcagcaagccaagaucgcacuacuguacuccaaccuggacaacaaagcgagacgccgucucaaaaaaaaaaaaaaaaaaaggagaauauggguuguauuauuucuaccuucagaauucauuacuagcuuuuuaguggcuuaauuauacuugaucaguguuuuuuuaagugugucauggguggguuaacauuuugccuguuuuuuuuuuaauuuauccuaauaaaguugucauuggcuucauauauaacuugcugauagcuauuucucuguauaugguaaagcaagauuguauguauaagugauccauugcaguucuugauuguaccuuucuuccauguuaaaacauacuuauguaguguuuugaaauauacuuuuaauauuaucacuucuuuaaauuuuguuuuagcauucaccugguucauuccuguccauccuuugauuuucagcuaucugagccaccgugccuggccuuccucuguuauuguuaucuaaagucuuuucaguaugccuauaggcugguuuuuauauugucauugugaaaauccagguuuucaauuguuuuauauaguggcuguuaaggaaauaaacaauuuaaguaauuugggggggggcauaaauaagucuuaaccaaaaaagauauuuuaucauagaggaggaaauaaauuccucaucgagacaccuaaaaacaaucagucuuaacauauugguauauauucuuugccuacguauggagugagagggggauggaagaaagggcaaaauggggaauagguuucuaugucaaauaucuucaguauuauuguuaauucacuuguuuuguaaacuaauagcuuauccucuugagcagggaagaacaaguauucuuugugguauauaaacuuuaaauguuugaggaaugaguagaagaaagacuugaacuucuuaauuuuuucuuuuucucucugaagauuuccauggagaaugauuaucugggaccucgaagaauugagagucuacaaaaagaagaugcugauuggcagcggaaagcucacauggcuguacugucuauucaagaucuuacugucaaguacuuugaaauaacagcuaaagcucaaaaagguagguuucucaguaaauuuauccuuuagguauuuuugaaaaugagugguuaaguauuuuauguucagaaaaauuacauagaaaaguauauaaagaucacucauaaucccagcaauuagagaaaaccacuauuagcaaauuaaggcacauccuaucagucuuuucauagauacauauauuuaaauauauauaauuuaaauaugaauaguaaauaauuguguuucuacuaacauacugaggaaaaaaccauaaaaccucacagaauuaaugcuuuccuggaaacuuugaaaguuaauaacaccggacaugugagaguauuuuuaaaguuucugaaagcuaauuuuauaaguguuuuaacugcagaacguuauuucugaggacagauugaagacauuagaaucuaagauacucucaaauuauguuuuagaaaugucggccgggcacgguggcucacgccuguaauccuagcacuuugggaggccgaggcagguggaucacaaggucaagaguucaagaccagccuggccaagauggugaaaccccaucucuacuaaaaauacaaaaauuagccgggcaugguggugggugccuguaaucccagcuacucgggaggcugaggcagagaauugcuugaacccgggaggcggagguugcagugagcugaaaucgcgccacugcacuccagccugggcaacagagcgagacuccaucucauaaaagaaaaaaagaaaaaaguuauaagcaguuuaucaugacagcaggauuuguuucucuuuguguggucagugaaaucuuuuucaaaugcuucaguauuaaguuguuauuugucuuaauuucucuuuaaaaaauuauuaauagcuguguaugaucgaaugcgagcugaucagaagaaauuugguaaagcaucaugggcagcggcugcugaacggauggaaaaacuccaguaugcaguuucuaaggaaacuuugcagaugaugagagcuaaagagauaugcuuggaacagcggaaacaugcacuaaaggaagagguaacaaaaaucaucagaaauauaaaaucagaaaaaguuacaguuugucauuuuaaucuuugcacaagacauuuuuuugauucgauaggcagugauuuuaugccaucuucaugagaugaaaacacuuagaauagguccugugacuuaaguugucauuagaagaguuagacguagcguauuucacagcaucacagugugaugguuggcagcacugcacuguugaucagaggggccagcaucagaauuucuuaguugcuguaaaguuuuuaauacuguaaaaacguaaagcuuuccagcaauuauuaagaaaguaucacugaccagagaaauucaguaaaauuucuaaggcaguggcauuuuguuaggauugauuauauaaugcuuuuauaccauuacauuuuggaacuucccauuuuauuccuacuggaacacacuggucucccccaucucccaccaccucuguacccgcuacagucacugucuauccuuuuuuacuauugacaguuauaaauauucauacccauuuugugggcugcccucauuggcuugaaaacacugaguacauauuuauuaaaguagcacauuuuaguugcuagagaagaacaaaucaucaucucugcuuuaguuauaagaauacagcauuauguaaaauauguauuuuuuuggcuuagguuguacagcaagaugguucucauugacauuuuugaagugcuuaugcucauauacacuuuuuguugauggauuuuuaucauuauuucauuucccccuuauuuuuauuugcugguuauuagaagguaaaauuggaacuuggcuuauccgggaaauuguucacacuuuauauucagaaucgcugugcauggauuucauccccaucucauguuccccugaggcauuucuacuauaauauccuuuucuaauuagcuuguuccccucauguuacuggcucucuggaguugucuuaaauucuagaacuuuuaaacuuaagucccucuuuuugcuuauaauagaguaccaccuuuaucuucaucuuuguuguuguuguugaaacagugucucauucugucacccaggcuggagugcgaucacaacucacugcagcccugaccucuuggggcucaagcaguccuaccucaggcuccugaguagcaggcacgcaccccccccaacaccuugcaaauuuuuauuuauuuacuuauuuuuuuguagagacgaggucucccuauauugcccaggcucaucuugaacuccugggcucaagcaguccuucugcaucugucucccaaggugcuggaguuaagguccaugcccagcccgucuucauuauauuaucuagcauuauuguucuaaccuggcuaacacugaguuauucugucaguggacagcugccuaagagagcaggggaggguaagauuucugacuacucuuacuguaguuggucuagaguaguagaggaaaaacgagcaugaaauggguccugagaguuugagaugauuaucuuggggagugggggggguccuauucccuggggcugucccauuaauguaauagucuggauuguauuugaauucuucacaguauuuguuaaaacugccagcugucauucuugccagguuuaugcuuguuuuguguauaauuuagauagguauugugcuuuguaucuauguguggugauguaccaauuuuauuagcauuaauuuaacaugcccacauuacucaugagaaagagaguaaaugugaauuauuaagcccauuccagaacaguucuuugccaguagagguuuugcaaaacaguacuacccugugauuuguccccauagguuauuuuuaaaacaaaguucuucuugaugugacaaaauuaagacaacccuaaaaaugaaaauguuuuuaauuuaaauuuaauuuaaaaauuaaauguaaaguauuucagaauauuugccacaagcguaauaccauacuugaaauaaauguucugaauuaacacugaaauauuaaauauuaccuaagcaggcaaaauucuguuugacuugaaagaauuaacugcucuuaggaguugauacuguuccuuuuaauuuauacccccuuuaacuuuuuaacuuuuuuuaacuuuuuuuuuuuuuuaaauuaauuuaguuaguuaaaauagagacagagucuugcuguguugccuaggcuguucucuaacucauggccucaagagaccccucaugucauggacucccaaaguucugagauuauaggugugagccacugcgucuggcgcugagucuuaauuauaaucauucuuaccccuuuuaggucauucuugccccuuuaagaauaugacaacccuguacucagaguaauguacauauauaugcaauuuugcacacaauuuuaguagguucucaaauuaucuauaucugagccucuuauuucagaaugacugcccauguucugauuuccucaucaaaacugcugaaaauacuguguuuuuagcccaauaccugugaaagaauccuuugugaguuuaacuaguuguagcuacuuuauucuacucuuucaauaguauacuccccaucuagauuuggaaauaauagcauaaucugaccaugcaaguaagucuuuauuuucaguucuauauuguuaauccagguuaucagauauagcuuacguuuuuuguuuuaaacuauuggacaagauuaaaauacauacaaccacacaggauuaggaguagaguauaugcuggaaguguuauuaaaauaaggauuaauguugaaauaaggagauuuucuauauaguuauuaauugaaauagaugaugauaaaauuaaaaugccaucaugagguugggcaugguggcucacgccuguaaucucagcacuuugggaggcugaggcggguagaucaccugaggucaggaguucaagaccagccugaccaauauggcaaaacccugucucuacuaaaaauacaaaaaauuagccagguggguggcgugcuccuguagucccagcuacucuggaggcugaggcaggagaaucgcuugaaccugggaggcagaggcugcagugagccgagauugugccacugcacuccaacagcuugggcgacagagugagacuccgucuaaaauaaaauaaaauuaaauuaaaaugaaaugaaauaaagccaucaugaagcaaaucaugaaacaucuggauuaaauuguagacuucuauuuugugguuaaccgggauuaaccagaaaacccuuuagauuccaauucguguggcugaaagacuuuaaaaaguauaucagggccaggcgcaguggcuuaugccuguaauccuagcacuuugggaggccaagacgggcggaucaucugaggucaggaguucgagaccagccuggccaagaugacgaaauucugucuccacuaaaaauaccaaaaauuagccagaugugguggugagcaccuauaaucccagcuacucgggaggcugaagcaggagaauagcuugaacucaggaggcacagguugcagugagucgagaugaugccacugcacucaagccugugcgacaagagugaaacucugucucaaaaaaaaaaaaaaagguauaucagugugcuuucuuucccuggcagaggauuuuaacaauuccccaucuauuuauaauuccuugauaauuucucugaacauacauaaucuaauagaauaugaaugcauacuagucuugaagauuagcuacuuauuuuugucuuucuccuacaagcauguagcuaaauuaugauuaacuaagguuauauuccccucuuucaguuuuaauucgucaaguauuuauugagcauugauuauauaccaugguggauaugagcuuaggauuuggacagugcuguccagcagaacgcccuguaaucauggaaauguucuauguuuacccucuccaguaggguaguuuucagccauauguggcuaaugagcuuuugaaaugaggcuuaugcaacagaggaacagcauuuuaaauuaaauuuaaauaaccacauguggcuuguggcuaccuuacugaacagagcaccucuauagaucucaguucugcaaacuuaacucuuuaggaaagcuucagugaguuccuuaaccugucuuugaaauguaaauauuauauaccuucuggaauguuaugauuucaugaguuaaugcauauaaagcauuugcuauagcacuugacauagaguaagaccuggauaaauauuagugauuauuacuauaauuguauguuauguuuugugccaguaucccagaagggaauacagagaagaaaaagauacauaauuuccaugcuuaagauguuuacuugccucaaccaacauuucaggguucacaaagcaugcuguugacuaggugaugugacauuuuguaugggccuugccagaaacuuccaauaguaagaagcugugaugugguagacacagccugagucugagcugaggugggguuuuugagguccuuguccaggcaaggagauugguuuuuaguuuucauuuuauuugucaauaaguagauuauuccauaggugcacacuauauauuucaaagagucuaaauacaaaaagguagguuccacucuaaaggccuuaguuuaucuuaaauucuguuuucaccauaugaauucuguuuuggcagcaguuaaaguuuaaaauguuuuagucccuguccuuagugcuuuauguguauuaucuuguuaaauucucaaacauaaccuuuuaugcuauaagcccaaaaccauuaucugaauucccugaagacagauauauuucagaaucccaggguuuuuuuagauuuuagaaagguaagauagagcauauaacuucagacaaguguuauuaguccacuaaugaaacacauggucacauuaaauggaauaccuaaggauuaaaaauaguuuaugaaaaguucagaucacauuuuuccacaaauggauugugagauuugguuugacauuaaauuaugggaauuuuccauuuuccaggauuucugacauguggaauucagauaauucugucaacuuguguuacccauauuugugcaguuguuacuggugaaaccuguauuuauacucaggcuugucuguuacuaauucucauguucauucuuucuacauaauagggcuaguuuugguugaaaacuugcccuuaacaucauucaccuuaugcuguccaagguuuuuaugacccuuuaaaaaaaagauauagccuugcccugucaccgaugcuggagugcaguggcacgaucauagcucaccacaagcucaaacuccugggacucagagucccuacugucucagccuccuaagucacuaggauuacaggcacaugccacuaugccuagcuaugacuuauuuucgaacccucauuucauuucuuguugacugcauauuuucuguaacucaaacagugguggaugcucagugaguauuuuuugaaugaaugauucaguccacagguagcucuuuuaauaguuccucuaaugucauuggaauuuucuagcacaguaggguaaaaggcagaacaagggcauaauucauuugcauaguuugcaaaaagugccaucugguuucaugauaaaguacagucaaaauagguauacaugaaaacuacuuuaucauuauuacacauggugagaaugauuguggagucagcaggguauguuguacuuacauggauguauggacaugaauugguacuucauccccuuacuagauuugcuguaaaacaauaacaauaacacuuugauauuuuuccgucuuuuugggcugguaaucccuaauuuuuucuaguggaaagagcacucuuguaggaaucaggagaacugagucuagcucaaacuuugcuagucauuaccuggaucacauugggagguuacaauuugguuugggguacugguauccugauacuugaaguauguuuaggagaguaaaaguugagcuaaguuaaauuuuaagauggccaauuuuuccuuugaguauuuaaacuacuuucagggcuucuuucuucuugcccagggaagcacugcucucagauauaaaaaagacaccccauuguggcacccaccuucccugcacugcuccauuaucuggaauuaguucucuuuucacccuggauucuguuucucuuaguucuguggcugucagcugaggacaggaaaacucagucuggaaauuucagauguuaaaacagggaggaaauuuggagcagggugcccgcuccauaccucuucaugccuuauacuaaggauuuugccuccacauugaagauuagauagaccucagaguauuauuuugcccucacagauuucucugagucauagcauccuuuucuccuuugcugaucucauaaaaguccuguauguucugguucuacaacccuuuagcuuuucccaaaguccaccacugaccuauuguuuguccuuucagagguugggauuuaacagacuccuucacugcuugucugccucugaugagguuuugguuaucuuuagaccacagcccuuggcaaauccacgucuggacucuuggucuagauagaacucaccgaaccaaaaaauugagggugaggucacugcuuguaagagaauaccuacuuccuuucucaguuugauuuuugauauugagugugugcugguagcacugcgcuucucaagugcuuuuaaaguacccuggcucugggcugcagucagaguacuguucucuuugugguugagaaagcugacagcguaaaggcaugucacugggggacuuucaacuuuuuuccuuagccaagagauugggcaggagagagaaacuuacagagugcuaggggaagaacuuagcagagcaucaugaacguagcagaaaauggucacuuaguuggguagaaccagaguagugaaaaugaacucacagccuggaucugaacaauaucacuggaaaguaaucuuagauuaagguuuuuagacugguuuacacuaagguuuuaacuuaacgauuccccacuugagaauaaagccuucuaacauuagauaucuuaccuguuuguaugcugugguaauagagagugugggugcagauacuggaacaauguauauccuacagcuguguuugcagagcugggcaagagccccaagagaguaugaaaagggauguuuaucaucuaaaguggcgaguccacgagucucaagguagacauuauuccuugguucuuauuuuaugacuuaggacaaaaacaacaguucauauuguucacauuccccucccuagcugcuauaauuaaacccacuuugggguuauauacguuguuugucacccauaaaauauuuccuaacacagcgggaucacucacagucuuacacuuagauaaucuauuaaguauccguuuauaaaauauucauaaaacaaaguaccacuguauuuaauucaccugguuauuuuuaaauuuuuacaacugcacguuuagacuggagccuaaccauugcuuuucaguucaaaauucuugugaaagggauuugaaauuauauuuuaaggaaaaauauucuaauuauuggguaagacuguguagauauauagacuguaaagcaaaagcuggaauuuucuuuaaaacguauucuuuuuaugugcugacagguuuuaccaaccucgccagacaaaagggaucauuuaggaaaauaagaauucacugucuuuuucccuguagguugucccuguacagccagucaaguauuucuuugguauucugggaccccagugaugucucacaugagcucguaaacaauacucuuaauaauuuucccuuuuguuccucucgucuccuccuuugaaggucacuccuugggaagccacuugaauccagggcuccucacuauugcuccuuuggcucugagggcacacugaugcccguaucggggcuuuccuggagcugcuaagcaugaaccuuuaaacuaccaaagcaguggugcuauguucuuggaagaaugcuuacugucucacucuagagaacuaugcuuguccuucacaucucacugacucuugaaaagccauuccuuuggcuucuuuuaucugccuuuuuccguacagccaaauagaaagccauagaaauaguaggguuaggaaccaguuaucuaaaguacacuuuccccuuggugguuuccuucauuccuggcaaaaauuuucccacuccagcaccgagaacugaccaaccaagcaaaccucacagaagaccauccuucacuuuaugagccaugcccagaaauuucuggaucucacuuuaaguucagccuaggacguugauuacauuuaccuaaagugacaccuuacggauugcaaggauuuccaucuaaagcaauugucuucugcuguuccagucacauauucucaccucacucuauagucagcagaucccagaaccuagccagucugugaccauggagcaaagcaaaaccccagauauguggcauuaaccagcuuuuaccauucuuguaaauaucugagaauagccccgucauuuucauauaucucugugaaaagaacaacuacauaacuuagcauccacuuuugagagggaaagcauuuauauccagaugauacauauauuauuaccauaaauaugcauaaguauaacauaaacauuaaaaccuuauuuuuaccauguuugccuacuuccaccauauaauaugacuugauuauuacuguuuuauacauauauauauauauauuuuuaaagucuagauuccaugccuacaaguuucuuucugagaggaauuacuuaauagguuuaugcuaucugauuaguauuaauuuuuaauacuaacucaauuuucuuguccccaccagcuagaaauuuuuuaauuuguauuuucaaugcagaugcagaguuugcggggugguacagaagcgauagcacgauuggaucaguuagaagcugauuauuaugaucugcaacuucaguuguaugaaguacaguuugaaaucuugaagugugaagaguuacuauugacagcgcaacuagaaagcaucaaaagacuuauaucagguauggcgugcauuuaaccacauaaguucaccaaagauugaauacaugagaaaauacuuauggacuagguauguuucuuuuguuaagacauuuaaaaaauuguuuucuguagggauagagugugggggggugauuucuagcauuuauugagcacuuacuguuugccagauacugcuaaacacuuugcauacauucacucuaugagguguauuaaauaauaaucaccacuuacaaagaagcuuaagagauaauggcuuugccugagguugcagagccaguaaugagauuagaaccuuguucuuuccaaacccuagcccauauucuuuaccacuacucuuuuuugcuguucuguaacagaaaaaagagaugaagugguauacuaugacacuuacgaaagcauggaggccaugcuggagaaggaagagauggcagcaucugcguacuuacagagagaagagcugcagaaacuucagcagaaagcacgccagcuggaagcaagacguggacggguuucugccaagaaauccuaccucagaaauaaaaagguauuuaaauauugcuuuuguucauuauuuagucuuuuauccguaucuacuaaucucaucuguuuugucuuuaaaacuugcuuauguuuuaaaacuaaguaagcacuaucucuuaucagugcucaaugcguuuauagugcucugagaauugcccucuuaaacacauuggaacagccaauagugauguucucuuuaccucuagaaacacuaauggugacucugcuaaaggccuugacuacaggaucccugauaaugugauuccuggcucccuuuuuauuuaaggaggcccagcgauguuuuuuacaagcccugauucugaccuuaaagaauuuuauagauuguuauuucuuuauuuaacuuugauuacauuuuagaauguuugauucuugauauuuggaaugacucauuuuguggaaaugugauucuuccugugucuuaaaaaauguuuugcacucuaguccagauguuaacuaucguggagcuguuucuagucacuguaaguguagaguuggaaucuggaacuagcucuccaaccuagaccaaacugaugacugugugguacugauucgcuuuaagcucaaguauuauaaaaguaugucauguucucugagaacccaccuuccugcucuucaccacauuccaaggcuaccacuuccucauuccacagaaaaucaauaccuuugcuuuuugaaauagauagcucuugcacauuaaagaaacucagacaggcauguauccacaguaagucaagaacccaggaccuucuaucacguuguccaucaacagaacaguuaccuugccauccagagcccuggcuuucacauaauuaugugccuuugcuauuuccccgugacagugguaauugaaacccacugcugugucagcccugguugugagcuucauuucacguuccaaucugcaccaaccagguaaacauugcaggcugggcgcgguggcucaugccuguaaucccagcacuuugggaggcugagguggguggaucaccugaggucaggaguucgagaccagccaacauggugaaacccugucucuacuaaaaauacaaaaaauuagccaggcaugguggcacgcgccuguaaucccagcuacucgggaggcugaggcaggagaaucgcuugaacccagaagguggagguugcagugagccaagauggcaccauugcacuccagccuggacaacaagagugaaacuccgucucaaaaaaaaaaaaaaaaaaacauugcagugauuucagcaggucuuauagaacaguuuuaggggagaaugaaaaguaaauaagauuucagaagagcacauuuuugaggaauauuaggaguauuuuauauauuacuuuuagguguauagugcaguacuuuugagacucggaauuugcaaaccugcaaguuuuugaaaaugcuaugcaauucagacuuaauugaaagucugauuucauuuuaauucaccaguaugcuaggcacauuguuagacuuaggauacaaagaugagcaaggcauagucccugcuccuccuagucuuuuagagaaggcaaaccaggugaacagaugaguguucugccggccaaaaacagcaagagcagggagugaggaaaggcuucucugaagagaugacacuuguacuggcuuuuaacaucugaauagaaauuggccagauugaugguguugggguaauuacaagcaggacagaauaguuuuuagcaaagacacugaagcagaaaacagcaugguuugucagagcauucuacauuguaagacaugcugcagggcggggaccaaguuaugggaaauuuuacauaccacauuaacaagccugagcuuugucuguaguauaaguuaagcaaagggguaguaugaacagauucacauuuuagcaagauaaggcagcaugaaaaauagguuagagggagaagagauggaaagguucugauuggaaggugucauuauccuccaccucaauaagguugagagguuaagacuaugaaguaagugggugccugugcaggguaagagauggacaaaucuugaacugucuagaucugacacuuugcagaaaaaguuaguaggauuuagugauguggugaaggagggaggaagagccauucucuaucaacccucugguuucuggauugggcauugagguagaugauggugucaccaaccaagauggaaaacccagaggaagagcacauaugggugggaggugauaagcugaguuuuagacuugcauauaagaggucuugggcauccagguagagauggcugugagacaguugagacaauugggcaccugggucuuauaagaguguaugagauggucucagaacaacauacugagcaggugauuuuuaaaauauuuuauuuauuuuuuuauagagacaggggcucacuauguugcccaggcuggucucaaacuccugagcucaagcaauccucagccucccaaagugcugggauugcaggugugagccacugugcccagccugaggaggguguucuuaggaaugaugagguggaggugggaggcugauaggaaagagcaagggaaggugguggagcaggauagauacauaguuugaggaagaaaaaccuucauuguauuuaauauuuguaauucaggaagcaaaacguucuuggcuaggggugagaaagcauuguaaagggcacaggcuaugaaagacugagcugcugugauguagugcgaggagaaaggcucuaaggaaagaacacuggggaacauuugaaagugugugcagaagaacgggaucaaagagaaaggguaaucgaaguuggaagaagcaggagagcucgaagucauagaagugaagaugaugauuccacacaacaggauggucaguaggcucaggugcuccagaaagguaaaggaagaaagaaaugacuccaugacauccaauauugggagacuauuggggccuuauguucagaguuucgagaaaaguugugggcaaggaguagaucuugguggucugagaagggagugcagcagagguuuaaagcagugacugacggaauagcaaaggaaacuguacaggugaggggugaagaggagcaaccuuggugaccauggcccacagagcuguguacucuucuagcaguauuaagagcuucaggcugaacuuaauaccggcuuaauaccagcucuucccuuguugauaaguguuagcucauagcaauuuaaucaguauucuucagucuucauuucuguguuaaucuaaaucugaaguagggaaacccagccuuggagaaucucuccauuuacacuugugugccuguaccccaagcccagcaacugagguggcagaacugcagagggaaggaguagugaaauaaggaaggguggugaaaagauaggaaaugcaaaacacuaaguccuaaaaagaaaagcuacugagaagaucaaauauacaaggaaaaacaaaugucucccuauguaacauaauccuauauucccuuguuuacauaucaacaugcccaaggucacuggcuucuugguuucucuggcacucaucuuaagauugcauacacaguucauguccugccucaccccuugaaagaguggagauaggugguccccggcugugcuggugaagucaaugcuuugugauuaaacauuucaagaagaguaacaaaaauaacaauuuucuuuguuuuuuaucuucuuuaauucucccaguagucaaaugaaauccagagagcucagaaaauuagaaucauuuucauacuucauuugguggcaaaaccagaccugagcuaacaugaaguuauuuauuaucuuauucucacuuugacaauucauuuaacuauuacugcuuauuaugggauaugguuucagaucuugcuuauuaggauauauaugguauauacaacuuaacaccauucucuaaauuaucaaaaaacuuugaauuucaaaacaugucugaccucuguucuagauaagggauuguggaccuguauccucauuuauaagcaagggaaccaacgcuucugguagugacauaaaucaccuaaggaaaagcagcuaauauggagcagggguaggauucuguccuagacacucagagaccugaguuacuguaucaccaagucaugacauuaucuaacacgcccuuuguuuuccccauugcacuggauagauucuugauaggcaauagagugaaccagaguggguaaagaacaugaaguaaaaaaugacauuuugcuuuaaaauaacaguuuacugacuucaaagguuauuauuugacuuucucuaauugaaagagugaucauuuuaggcugggcaugguggcucacaccuguaaucccagcacuuugggaggucaaggugggcagaucacuugaggucaggaguucaaccaaucuggccaacauggugaaaccccgucucuacuaaaaauacaaaaaaauuagccaggcgugauggcaugcgccuguagucccagcugcuugggaggcugagaugggagaaucucuugaaccugggaggcggagguugcaguaagccagagaucaugccaccacacuccagccugggcaacagugagacuccaucucaaaaaaaaaaagugaucauuuuaguauagcuuuggaauguuggagacuaacccuuuuaucuggaaaacuucuccaaauaguuuccuuaggaaaggacacaggguaaaugaagauuuagcuugguacugguaaaaaguuaccagaauauagugcauaauuuuauaaaguagugcauaucucacaguuauugcaaaaauccuguuuuauauggugauuggaaaauauaugcuuuuuuuucauaguuucuaaauaauuuugauaauuuugacuuucuagucuuccaggucucuugcagcucuuaugucugcgaccaaaagauucagaucucauauuguuuaagccagucuggacaaaaaauucauggucuuuaacuugucagagggagcuuaacaauacauauuuuauauaaguaaauacuuucauauucuuuuuugcccagacauguuuaaagagcauaaugaagccaggugccaugacucaugccuguaaucccaguaacucaggaggcugagccagggggauuacuugaggccaggaguucaagaccagucugggcaacauagugagacccccaucucucagaaaaaaguauaaugagauguggaaucuucuggaugcagacuucagaucugaaagagaccuuucaggacaacccccuucaguccaccuugccccaucccuccuccuucaaaaaagagaaaccaggaggucuauagaaguuaauaguuucauagaggagucuuuucguaagauccugauuacuuggcuuuuacagcuucaguuguccaaauaagaaacaagagguggucaaugugauacuuuguucuguaggugguauauauuaagaucaaaauuuaaccuuggugugguguucagagucuuucaaguuucacuuguauuaaaacacauuuuauguauuuacaggaaauauguauugcaaaacacaaugaaaaaauccaacagcgcacucggauugaagaugaauauagaacccaucacacaguacaacuaguaaguuuggauucgaagauuuugaacaaaacuuaauuuuuuugcauguuuuagaguggauaaaaucuguagagaaugauaaaaaaacuuauaacugcauguuaacauuaguucaguuuauauaaugagcaguuuuuaggcaaaauugauuggagaauacagaguuccuauacccucaacccgcacacguagccuccccuaccgucaacaucuccuauacuccuguccccacacuugauagccuuuccacugucaacaucccccagaguggaauauuuguuaaaaucagugaaacauugaacaucaccauuccccaaaaucuguugcuuauguuaggguucuuucuugguguuuuguguucuguugguuuugacaguguauaaugacaugaaucugcuauuauaguaucauauggaauaauuucacugcuccaaaaaucccuuuguuccgcuacucaucccucucucuccccaagccccuagcaaacacugaucuuuuuauagucuucauaguuuugccuuuaccaauguauaguuggaaugauacaguauguaaccuauucaguuggccucuuuaacauaguaacgugcauuuaagguugcuccaugucuucauggcuugauagcucauuuuaacaccaaauaauguuccauuguguggaugucucaguuuguuuauccaugugccuauugaaggacaucuugguugcuucuaagcuuuggcagcaauuaguaaagcugcuauaaacacccauggagggcuuuuugugcacauaaauuucagccaauuuggguaaauaacaaggagcaugaaugcuggagaguaugguaagaguguauuuaguuuugugagaaacugcaaaacugucuuccauaguggcuguuccauuuugaacucccaccagcaaugagugagaguucagguuuuuccacauccucuauagcauuuugcuguuguuacguuuuugaauuuuagccauucugacagguguauagugguaucuuuuggugugugugggugcguguguguguuuaagagauggagucuugauagguugcccagguuagccgcaaacuccugggcucaagcaguccuccugcuuuaaccuccugggacuacagguauggacuccugugccuggcuuuuacuguuguuuuaauuugcaaaucuuuaaugcagauauauagauaaauagauacauauacagagagcgaaagagcgcaucuguccaaaugccuacuugccccucuauauaucucuaguaaggugucuguucagaucuuuugcucuuuuguuuuuuggagucuuauucugucaccaaggcuggagugcaguggcgcgaucucggcucacugcaacguccaucuccuggguucaagcaauucuccugucucagccuccugaguagcugggacuacagacaugcaucaccacgcccagcuaauuuuuguuuuuaguagagaugggguuucaccauguuggccaggcuggucuugaacuccugaccucaagugaucugcccuccuuggccuccaaaugugcugggauuacaggcaugagccaccgugccuagccuuuuugcucauuuuuuaaauuggauuuuuauuuucuuauuguugaguuuuaggaguucuucauauauuuuggcuuacacuccuuuaucagauaugucccuuuguuuugcaaauauuuucucaugaucuguggcuuguuuucucauucuuuugacagugucuguugcagaacagaaguguuuuaacaaaguccaauuuaccagcacuuucuaucaugguucauuccuuugguguugcaucuaaaaagucauugccaguccccaaaucagcuagauuugcuccuauguuaucuuuuaggaguuuuauaguuuuguguuuuauauuuaagucugugauccauuuugagguaauuuuugugaaggguauaagguuugugucuaguuuaggcuuguggacuuccuguuguuccagcaccauuuguuuaaaagacuguccuuucuccauugaauugucuuguuccuuugucaaagaucagaugauucugucucuucagucuauuuuuggguguccuauuuuguuuuguucaucuaggucuuuugccucuccauauaagcuuuagaaucagcuugucaguagccacaaaaaaauugcugggauuuugauugggacaguguugaauuuauaagucaaguagggaugaccuaauaucuuuuuuguuuuuuucauuuuaaaauacuucuucuuuuaguuuuuuugcuuuuuaauuauuauguuuauuuuagccucuaccgccuucuccuacaccuaacaucuuaacauugaauauuccuauccaugaacaaagaauauuuuucaucuauuuaauucuuugauucuuucaucagaguuuuauaauuuuccucauaaagaucuuguacaccuuuuguaagauuuauaccuaagauaccuaagucuuucuuccucuucuuugucagggaggugguaauauaaauaguauuauguuuuuaauugaaaacuccaguuguucauugcugguguauuacaaaacaauugacuuuuguuaauuaagcuuuuucuuaauaaucuauaaucuagauuuuuuuugucaguuuucuuucagauuuucuacaucugucuucagacaguuuuauuucuguauagcuuuuauuucucuuucuuauugcauuagcuagcacuucaguauaauggugaaaggagugguaagggggacaucuuugucuuguuccugaucuuagcaagaaagcucuaguuucucaccaguaagugugauguuaccuguagguuuugggauagauguucuuuaucaaguagaggaaguucccccucuauuccuaguuugcuaagaauauuaggaaguucccccucuauuccuagguugcugagaauauuaguucacuuuauauaaaguuacauuagaaaccuucuccuacucccauauugcugugccgcaucccacacaauauauauuauccugacagucaucuuuacagaugugucuuaaauuaguuaacaccaguaauuuguacuuaaauaucagaaaugccaacaugaccauaucucuguauuuggauauuucuaaaauuuucugucuuuagcaucauacuaaaggccaaagggcuuaaauuugucuccauuacuccuuaaggcacauucuuagcuaaugcugccccuuacucuucauuuuaaccacauaaaauuagccaaacuacccauaaacuauaagauuaccuuucuccuagaaucuagaaauagauuaauuaauguacuuuuauuuuucauuacuguuucugugggucagaaacugcuuuauaagauuagucaggggaccagcaugacagugagguaaguugcucccugcuauaaccauuuguacuugcauuaucaguuuacuuaugaagguuccacacuuccaauauauuucuuuuuauaaaacauaagauuuugguggaggggaagaacuaauuaacuuuuuagaaugaaugaguaucagaucuuuuucccagaucuauuuuuugggggcaacaggaguaaaaauuaguaaaucgauuaucuuucuuuuccuuuuuuuuuuuuuuuuuuuuuuuuuugagauggagucuuacucuacccaggcugaagugcaguggugccaucucugcucacugcaaccucuaccuccuggcuuugagccauucuccugccucagccucccauguagcugggauuacaggcacaugccaccacaccuggcuaauuuuuguauuuuuaguagaugggguuucaccauguuggccaggguggucucaaacugcugcccuugaguuaucugcccgccucgccuucccaaagugcugggauuacaggugugagccaccacuccuggccaagaaauugauucuuaagguaaucccaaagauaaaugucaucugccuuagaauuuugccuaauaucuugguuggaauauauaauugucagagaaugaauccauuaaauaacuagucaucuuuaacacauacagauaaagcauaaugaaaguuagcuuagaucaaaauagaucauuguuuuucaaugcuaguuuuaaaccaccagugucagaaccucuuaugugguggauuguuuaaaauacagauucuuagauguuaaccuuauuauugcaacaguuuccccuggacauccuugugaauuaaauaugcaagacuaaggaaguuuauuuuaauauuugauaguaaacucucuaaaacaaaauaugaggauuacuuauuaauacuacuauuuuaaauuguuauuagcucaaauuggauaagagaauucuguuuuccccauuaaagaaugaacucuuauuuuuuguaaguacacucaaaacuccaggcuuucacuucaagaaaacauacaugguggcuccugucuguaauccuagccuuugggaggccgaagcaggaggaucacuugggcccaggaguucgagaccaggcugacccugucucuauaaaaaauuuuuaaaauagcugggcaugguggcguaugcuugucuugggcacaugcuaacuuauuucaggcucuaagagcccuuuugaauuguguucaugugugguguaucuuuguguccuuuuguguaaauuaguaguauauuacuagauugcauuuuauucagaaaauuagccuaccacaccuucuuuuuuuuuuuuuuuuugguagagauagggucucacuguguugcucaggcuggucuucaacuccuggccucaagcaauccuccugccucagccucccaaagugcagggauuauaggcaugagccaccacacuuggcuuuauuuuccaguuuccuguugucucccugccacccuuacgucccugcucauacuuucuuguuagaguuuaugauacaaucacccaaugcaaaugcaacaguaauucucauuagaaauuauauuguuuagggaaagcugguggggaagaggagagaaaugauagaagaauagaaugggggguuggaucugaaaaggacaggagaacaauggaagagaggguaguuaauuuccauuugaaauuaucuggucuggucuucugggagguaucucuaauuuuuuaaaacaaagcaagaaaauagacaacccauuuaccuauauagaaagccuuuucauuuauuuaacuaaaauuaauuuuaccaaaugagauuuuauuauauagcuuuuagaugauucaacucuauagggaaaauuaaaaguuuguuuagauaacugccaaaaauaagcugugauacuaaaccagaugauucauggauaaugcuugaaaaauauuuuucuaacugcugguuauauugguuguugauuugauugcuuuuguucguuuguuuuuuugagacagagucccacucuguugcccaggcuggaguacaguggcacuaucucggcucacugcaaccucugccucccagguucaagcgauucuccugccucagccucccaaguagcugggauuacaggcaugcaucaccacgaccggcuaauuuuuguauuuuggguagagauaggguuucaccauguuggccuggcuggucucgaaccccugaccugaggugauccacccgccucagccucccaaagugcuaggauuauaggugugagccaccgugucuggcugguugcugauuuuauuuuuuaaagucaucuacauuuaaguuagcauaauauagcagcuagaaguauuuuacacuaaaacuguguauuaaaaauauuucauguuucaugcuuucauauuucauguuucaugaaguauuaaaaauauuucauguuucaugaacaaaaaaaaauuuuguucagugaaucauccccuuuggcccacauuaggauaacuucucaucuuuuuuccuauuaaugauaaaaauugggacacagcauaauggaauuauuauuaauuuuuuaccagaagagagaaaaauuacaugaugaagaagaaagaaaaagugccuggguuagccaagagagacagagaacacuggauagacuucgaacauuuaaacagguauuaaaaguaaugguccauuuauuguuuuucuuuuuuuuuuuuuuuuaacagagcuacauauacaccuguaggauuucuuugugggaaaaacuugguuuucccuuauuuauaaacuauuauaaccauggaaguccuuuuuaaaauuguuuuaauggcauggcuccauuuccucuggugguuuuccgaauuuaguauucuugugaccuuugacccacagcuucaguaguauaagaggaaugauaagggccucugggaaaccuagauuccucuugaguuuaaaaaauuaguuaaaucacaacugacuauccagcucaagcaucagcauguuauuuauuccacauacaucagccuguggugguaauacaucaaaugaccauuggcagaauuagagguggaggggagcagcauauuugagaaaugcuucagcaguucucuugccaggguaagccaugaccacacacugauaccacaguauccacacaucuccucagaacugugcugaagccucacaguucucauuuuuaaaguacucuggagccuuacuucaguuaugcaugcugaaggaucacuuuguaggugaaguaggcuuuugaacaaguguuacaguggaaaaaaaggaggugaggcaggggaaaagccuuguuauuaaguaaauguggcucacgccuguaaucccagcacuuuaugaggcugaggcagguggauugcuugagccggggaguucaagaccagccuggguaacauggcgaaacccugucucuauacaaauuagccuggcaugguggaacaugccugugguuccggccauuuggguggcugaagugggaggauuaccugagccagggaggucauggcugcagugagcugugaucauaccacugcacuccagucugggcaacagagugagacccugucucaaaaacaaacaaacaaacaaaaggucuuaccaugguaaaauauauauaagaguucuaccaguaaguacugaaaaaaauguauuucucucuucauucugucauaaaauggauauauaguugauggagcuuuuuaaaaaugccaaguaaccuguuaaagaauauuuuaauuuucucgugugugcauuugaaaacauaggaaacuuuuugcauaccaguagcauuuauacauuugacaucacuuauguuuugcauuuuacaugcuauuuguuuuauacauuuaguaguuuuauucacuaaaaaucuuuuuuuaaucauaauuuugaauauuugaauuaucaaucguggauuugauaggcaaauaauaaauucauaauuguuuguaagcuauuauuagguacuuucggauuuucuguauaacuuuaagggugaaauaaccaauaagccaacauaacauuuuugagauggaaucucacucugucacucaggcuggagugcgguggcacaaucucggcucacugcaacuuccgccucccggguucaagcaauucuccugccucagccuccugaguagcugggacuacaggugccugccaccacacccagcuaauuuuuguauuuuuaguagugacgggguuucaccaugucggccaggcuggucucaaacuccugaucucaggugauccacccgccucggccucccaaagugcugggauuacaggcgugagccaccacacccggccacauaacaucuuuuauuugaaggagaaaauaaauaggcaugugcucauaaauuguuucaauaacauuuaaccaguuccaauaacuucugguauuuuagagguauccugggcaagucauacuuaaaucaaccagauuacgacuagcucaugcaagaagaaaaggugcagcaaguccuguucuccaagaggaucauugugacucuuuaccaaguguguuacagguagaagagaaaacugaagaggugggagaaggaagagucaagcgugggccaucacagacaacagaaccccagagccuugugcaacuugaagauacuucauuaacacaacuugaagccaccucauuaccucucagugguguuaccucugaacugccucccacuauaucucuuccacuuuugaauaacaaccucgaaccauguucuguuaccauaaauccacucccauccccucuuccuccaacaccaccaccucccccaccuccucccccucccccaccaccaccaccucugccuguugcuaaggacaguggcccagagacacuggagaaagaucugccuagaaaggaggggaaugagaagaggaucccaaagucagccagugcccccucagcacaccucuuugacagcagccagcuggucagugcacggaagaagcucagaaagacugcugaagguuugcagaggaggagagguacgucaacauauuuucaugguccaucuguuguaugacaucaggcauaguaaaaaacuauauuuuuugacguugcaaagcuuaaaacacuuuauuuuugacauuauuugauaguaaacagguuuucaaagucacacuagaggagaauucuuagugcauaaaguacacagaaauguaugccuucuugggcuguuaggcauguuuuaaaaacagaucuucuaaagugauacauucauguuugguaauguauaauggguggcuccuuuuguguuagggaaaaaguuuugauuuuaaaccugagauuuuuaaaaaaauacucauaucagaaaggguaagauaucugguaaggacugucaccacagggaagacauuggcaggaucauguaacauuuguucauacauuuguugaggacuuuuguguauuuguauaaagaagcaaagaagaacagggaguaaucuguucaacuuacaaugugacagaugugccucaauaagguuacuauuuuuuuuucuaauuuuuuuuguuaagagagauucaagcacaaauaaaauuauuucuaaaaagagcagagaauaacccuugccuuuugccuuuaaggaauuugcauuuugcauggggagaacauuauauaaauguuacauauuacuuguauauuacauuuuaaccugaaggaccauucuauaaaacauuucuugauguaaucugaguaggauuucacauguaaaacaacuaaaugaaaaaagcacagucuccauaauaaacaaaaauuaauuuuuaaaaacaaaauguguaaccccaucacucugaauuuggguggagcaacugcaauauggaaauccuuugggaaucacacccauaauacuacuaagaccaccucccaguucccaaucuggucacuucucucauguaggaaaugauaggaauaccaacaguacccaccauggauugggucuugggauuuucuaaaaagaaggauaauuaggaucccuuguguucugaucaccuucugcacacauuucaugauccauuuugaagaugguguuucagcguccugugcuuucacaguugcgaacgguagagguuauacaguuucauucuaauuaagugcaguccuaacuguaauacuguucuguuucauuuuccaaagugagcucacccauggaugaggugcuagccuccuugaagcgugguaguuuucaucugaaaaagguugaacagcgaacucugccuccuuuuccugaugaagaugauaguaauaauaucuuggcacaaauaaggaaagggguaaaauugaagaagguacagaaggauguuuugagagaauccuucacacuucuacccgauacagacccucuaacacggagcauccaugaagcucuuagaagaauuaaagaagcauccccagagucagaggacgaagaggaggcuuuaccuugcacagacugggagaacuaacaaguaaacggccuuauugucuuuaguagcauucaguaauacagguuuuauaucggaugaugagguuugggguauuuuuuauugagccugaggcauaucguuuguuuuauaacccaauuuuagcauggaucacaaauuuaugaacuucagguuuuacuuaauucuguaguuucuagaaacuuaagauaacuuuuuaaugauuauugcuauguaaauacuauuuuuaaaaauguccuccucauuaaaaauuucugcuauacagcuguaauugcaaguaaagugacagucucauucuugcccuaaaaaaacagaaaagggccuggcacaguggcucacaccuguaguucuagcacuuugggaggcugaagcaggcagaucacuugaggucaggaguucaagacuagccuggccaacauggugaaaccucuucucuacuaaaaauauaaaaauuagccgggcgugguggcgggcaucuguaaucccagcuacucgagaggcugaggcaagagaaucacuugaacccaggaggcggagguugcagugagcugagaucgugccacugcccugggcaacagagugagacucagucuuaaaaaaaaaaaaaaaaaaaaaaaaggcuuuccagguucagugguucgcuucuguagucccaguuacucagagguugaggcaugaggaucucuugagcccaggcguucaaauccggccugggcaauauagcaauaccccgucuguaaaaagaaaucaauacgucaauuuuuuuuuuaaugcaaagccuuuucugacaaaguauuucaguaacaaacuguuaugcacacugaauuuugaugucauguuagcugaccucaaaggaguuuucuaagaucauucuggaaaaauuguugcauugucugauuauuuaacuuucuaaacccuuaaaaaaaacuacuuauugucacaguuacuguauuaucuagacaaauuugcagguaucauuaauauauaaaaauuaucuacauaucuaaugaauacuccuauacauauuaagauucucuuugguuacacauguagcauucuccuaauauaauagagagcuauagucuacuacauuuuaauauacuaauuauagaguaauauggcacagauuacaccaaauauauagaaacauuaaagauaacaugguauaaauuaaacaguauaucaaauuuauaaugaugguaacugaaauguuguaauuuguauaaaauuuauagaguauacaaacauguucuauuaauuauuauucuuucuugauggaauauguuucucuaggcuucaaacauucaccaaaguagggaagacuugaguccuagaagggaauaaguaaaggaauaauuaauucauguguuagcccugugaauuauuuuuguugaauuucuuuuuuuauuuuagagacagagucucccucuguugcucaggcuggagugcaguggcacguucauggcucacugcagccucaaccuucugggaucaagcaucccaaguagcugggacuccagacacaugccaccaugccgggcuaauuuuuuaauuucuuuguagagacagggucuccuuaugguugccccgauuagcauaauaauucuuaaaacauguuugaucauaagaauuaacuuggggagcuuauuaaaaauggacauucuguccuugacuuaagaauucugaguagaacaacaaagaaaaaaaaucuuuuuuugacaggguuucacucucucacccaggguggagugcagugacaugaucucggcucgcugcaagcuccaccucguggguucaagugaaucucgugccucagccuccugaguagcugggauuacaggcgacugccaugaugcccggcucuuuuuucuuuuuuuuuuuuguauuuuuaguagagauaggguuucaccaucuuggccaggcuggucucgaacuccugaccucaaaugaucuacccaccucagccucccaaagugcugggauuacaggugugagccaccaugccuggcccaaaaaaaagaauucugaguagaucuaauguauaugcaaguacacaucuagauuuugaagacauaauauaaaaauguaauguaugucaguuuuuaaacaacugauuacauauugaaagauucuauuaguuacauuagguaaaauauuacugaaagcaguuucaccuguuccuuuggguauggguucauuagguaaauauuccuguaguaccucuccaccagcaucugcaucaaucaauaacuuaaaaaggguaauauuacauucaccaugauucagccaacauucaguaguagcauuauccugcuuuuuuuccuauuauguauacaguuacauguaacagucacuuuguaugacuuauguuuuuggaucccaaaguaacuucgaguuauuuuugcuuguacauauguccacuaugcuuuguaaaggaauauauauauauauauauauagagagagagagagagagagagagagagagagagagagagagggaugcauaucaguuugugaaugucuagacucucagguaugucuaacugggaaucuuuuccauaguggauauuuguagguugucucccacuuuacaguucuuacuaccauguguuguuuccuucugcuguagcuucucaggaagcugcuuaagcuugugccuaaaacuaccaucuuugcacugacuaauuccacagcuggaccuucacauaaauguguguuuagcucuuucauuacagaugguccacaguggcccauucacagcacaccagcagcugcucaagucagccuauccuugucugucuccucccaucccaccauauccugccuaacccuagacauugcaucagcauuuuguauacucaaguggcugggauguuacucauagcuucuggcuacuaauuuagccuuaguaucagauguuaacauggugcaugguguauacacuuugaaaauugcuuaaaacuuuuuucgggggugugggagacggcugauggcuggaauaugugguacaauguugagagagaaacagugaaacacuuagaaaauauaugagcuuggaaguuugcagucucccuuuacuaaaugugugcuaacccagaagcaaaccauagacuaguauggacugauuaggcagugaugaaguagcuguguaucacuacuuugugaucauggagacuaaaaggcugugaacuuuuuaucuacaaauggcuaagaaggcuuuaccgcaauuuguauuucccauuaauuuauuagauuccuuuuuuuuuucucucucucuuuuuuucuuuucuucaagacugaguuucacucuuguugcccaagcuggagugcaguggugugaucuugacucacugcaaccugugccucgugauucaagagauucuccugccucagccuccggaguagcugggauuauaggcguguguuaccacucccagcuaauuuuuguauuuuuguagagaugggguuucaccauguuggccaggcuggucucaaacuccugaucucaggugauccaccugcuucugccucccuaagugcugggauuacaggugugagccacugugccuggccagauuucuugauuauagauuuugucauuaauguacuuauauacuuuuaagagcuaauuucuugaauauucauaaaguagguaaugaaggucccuuguucugccuuguucguuccccucugaaacucuucucuuuccagagauagccauagucaugcucaaggaaauuucuuaaaauguauguaauuacauagagguuuaaaauaaguuucaggcugagugugaacuuuaaguuucaggccuguaauucugcaguacuucaggaggcuggggguggguggaucacuugagcccaggaauucaagacuagccugggcaacaugacgaaacacaucuccacuaaaaauacaaaaaguagcugggcgugguggcucacaccuguagucccagcuacuugggaggcugaggcaggaggaaaucugucucaauaaauaaauaagcuucuaguuuguuuccugugagagucuuuuuuuuuuuuuugagauggagucucacugugucagccaggcuggagugcaguggcgccguauuuggcucgcugcaaucuccaucucccggguucaaucugggauuacaggcgcaccaccaugcccagcuaauuuuuuugaaguuuuaguagagagggguuucaccauguuggccagacuggucucgaacuccugaccucaacugauccacccuccucagccucccaaagugcugggauuacaggcgugagccacugugcuaggccccuguaggagucuucuaaaguaacuauagcaauguaguucaaaggaaauauaguuugagacauguaauuuuaaaauguccaauagucacaucaaaaaugaaaaggaacaugugaaacugauguuuguaauauuuuauuugacacaauguagccaaaguaguauccuucaacacauaaucaacauuaaaaacuaaggacauugcuuucuauuucuuuuuuucacacuaagucuucaaaauucaguguauguuuuauauauacuaguagcacaucucaguuugaaugcuaaggaucugauacuuaaugagaaauguccuaccaaaacagcaaaauuguauuuaauggaaaaauaguacuuacuguuuuagauuuuuaaaucaaacuggauuuaaaucaaacuagaucagucacacuagacacauaucaagugcucauuagccacauguagcuacaguauuagaaaaugcagaacuguauuaaguugguacuuuauucauguuccugucagcuuuuaucugaagaguaugucuuuuauauaaaugcuccugugcuuuggguacgccccauagaucuuaagcacaacacuuuucaauaaaaugcccgggugaaguauccauuuaaagauugguauuaauccuguccucuaaauguuagucuaacaaaaacaguuucuacugcauuuugaagacaccauuuaguuguucuuacucuaguagcaguuuauggggcaaauaguuuagacugaauuuaccuuuuuaguauauaguuuucauacaguguuagaguaaaaauaauaaaaaugaaaaucuaauagucuuuuaaaagugaucaaaaucuguauuuagauuauuuuguuuucauuuuuacugcuuuaagaauacagucauggccuuuuguaaaaaaugucuuuuuuacacuuuuugagggaacguaaauacacuguaucuuuaaagggucuuuuuuuuaauggucuguauuauuuuguuuguaaacaggugacauaacagaagaaaaauaucauucaagauugguucugauucuuuuggaaaaugacaguuuaagcacuugguuccucaguuggauaacauuagauccaaaguucauugguucaguggugugaagaaaggaagcacaauuggcagguuaucacuuuccagucguuccaauagaugaugguuaacaugaauuuuacaugugcaauguuccugacugcaaugaagaaaaggccuucuggagauuucuguuuuuuaagcacauucuccuuccauccacauauuuacauccuuguaauggccaguuaagcuagggcuugcuguaaguuggaagaacacuggguugacagagaucuacugugagcuguauugggacugcuuugagaaccaucuuucaaugcacugaaaagucaucugaaaaaauagcuucuuccauaucagcuuauauuaaauacugugacacucugagaaaguuuaucaucaugauagcuguaagucaggcauuaaaaucaaauggaaauacaccuaaaauguccgcauuacucauuuccaaaggauuuuucauaaagauguucagcaacaucugaaaagcugcauuuauggagauacaucuauuaauauguucacaacaugauacauuuaacauggcauauuuuuaggagucuuauacuuuguaagguuuugaaguuuccgugcuuuuaaaucacucuucauauuucuugaauuuauaauaguuugaauuuuaugugcauccuuguuuauggaaggcaguacuuugauaauauuucaaauuauuuuuauuuuguuugaauuauugcuugauugcuaugacugacaugacuuuccuauugagaaucaaaaaucaagauucaaucauagggaugcagaucuuaacucuuuucacaaauuaccauuuuaaguuuuuauuuuuaugcuccacagugaaaagcaugugcucuacaaagauagaaaguagagacaagucuccguggcuggcauuucaccaucuucacaugcacugaauggaauuuugggagaaugccuuuguuauagucacuaaaauuuuaaacuuauacacagcuuuaggugcugauuuuggcugugauggaguccugaaggacacauuuauauguuccagauuuucagcaggauuguugugggcuugaauacauguagaucauuggacucagugugcaguacccuguacauauaauucugcauaagacagaucuuggccuuucuguggagggaguuaagaacuaaaauaccaaaaaucacuuuauuucuuuuaagacaauuaucuggccuaaacccagaaagcaguacuggagcaaaagcccaguguauaugaauugguauuccuagagaaaaaaagaaaugcucacaccuuuguuauuuuaaaguguuuucuugaaaauaauuagggagaaaauuuucuggcaacagguuauguaagacaacaacuuuuuuuauuauuucaaaacaaaacaggcacaugccaccaugccccagcuaauuuuuauauuuuuuauagagacaggguuuugccauguugcccacgcuggucuugaacuccuggacucaagcaaucugccagccucggccugcuaaagugcuaggauuauaggcgugagccucugugcccagccugacaaaaucuuuuauuuauuuaaauguuaguaauacguuuauugaugagacuaggagcuucucugcagcaucuucauaauacauugguuuuaguucccacacuauucccacaucuuaucugggaagauuagaaauacagauguaauauggaagcuucaacagcauggggguggugauaguguccuauuugcccuugguaaaauauuaaagcguauuucuuaacccaaagagugauugguuauaugaauauauuugaaaaaguuaaagcaaauuugcaaaccuuuacaaaaucauguaucaauuuuaugcuauccaguuuuuacguacccaugugucaacauuucauauauccaguucuuugggugcugguucacuuuuuuucauuuauucaaauucagaaaaauacggacggaucuaauguuaaauuaaccagaaacccuggaacauucauaucuugagagggaauuugcuacucuuuuacuuuugggauuucauuauaaaauaggcucauuuuauacauauguccuguggucugucuuccagagugugcuguaaucauaagucucuagcaaagaguggaggguggaggguguguagaacuccacucagccucauggauacaucuacaagucucucaacccauccuguuacaguucuccaugagagucaccucacacuuggaaaagaaggagguuaaagcagaguauuguuggcagccagcuaugcccauccucuuguaaauaacuuuccaacacacccauuuccuugccuuaaggugcagguuccuacuucuacaaaauuucaaaugauugcaggucaaaaaccuuuggaguuacucacaaauaauaauaaaauuucaaauaacuagggucuacuuguccaucaagaugacauuaccaguggaacccaccuguuaauuuuaaaguagcuucagaacccaacaaaaauuauguaagccugguuaaauguccuuuuuucuucuugccucuaauaaaaucaggaucuucggccuugauacuaaauauguguauauuuaguuaugaugguacuuguagaugcucacauuuccaguuccaaacucgcccguacuuuuuaugugcuucaaaauauuggacacauuucuguuaauauaugauuucuguauccacaaaccgcuguuugcuuaugcugagucaauuuagaaguuaauuuccaaucuagucucaacugcaaugcauuuaaaauagguaaaacaaguaaaugaguuugggacauuuugagauuaauguuacugcccacuugacugucaauuucaaauggcuccuaaugcaaccaaaauuauaaccaauguagcauguguaggaaagguauuuuuaauuauuuaaaaucauuguguauauuacagcaguaugaggaaugccuggcuaaagaggauuuuuuaaaagaugaagaaugguuuugcuuguauuauauaggcuuacugaguuugugagcagcauaaaaacaaucauuccuuaauucuucauuguggaacugaaauauuucuguaaugcauuuuuuaaaaggagacuccuagacacagcuguaauagugggaauagaaauguagagcuuuucucauaacacaaaaccagaaaauaauuuucagcacuuugacuuacucuauguaauaaggaaaaaaauuguuuccacaaaguugaacuauguaguaauauuugguaacauauggcauggccacuuuauaucacagaaugugugucaaguugcaaagcauacuugggccauaguagacacuaagaauuaaaacucuuaaaucagugaaacaaaaacuaaugggcagcauucucucuguuuggaaugggaucaguauacaauuaauacaauuuaauuuuacacauucccuaagacaccauuuuuaaguuacagucacaugaguguuuguauaaauuuaagucaaugcuuuuagccuaggcaaagcuaaauacaagguuuuugggguuuucuuuuuucagcuuuauuauugaaguauuacaaacuuaacaucagauaccaauguguaaaaaguacuauuggguccuuaagggcucuaucagggaguugaaauuucauacgcuuuaccagguuacuuguaaaaaaugaacagcuguaagacauuucaaaaccauugcagacacauuguuaaaaugcagccauuugauaaugaaagcagaaaccuuaaguuuuaccuaauuauugcacuaaauguaaaugauaacauaaaauuaagugugcauuuuaaacagauucuauuucccacuuacugcuuagcauagaaaaagagcuaugguuagaggagugaccagcaagauuuauuucagauggaaaaggggugagaaaguggaagcaccuuacuguuagagcauguugcaucuauuuagugcuacugaacaauucaguaguuauuucugaacuuugcugcaaagugcucuuuaguuaaagcacauuaagaagggucacugcuuaauugcuuuguaaaaugaagcaaugguauuuuuuauccgauauaguguaauuuaaaaguuuuccuacaaagugaguuuauauuguugccuaaacuauguuauguaagcaaaggguuuggaaaggcgggagggagucuagauucggcgagagugugcguuugugugugugaauguaugaaaaguuuccccauuggguuauucuuaagauguguuuauuguaaaguuuucuacguuuugcccacaguaaauguacaacuucgcaauuguaggauuuaauugauugaauuccaaauuuauacugucucuucccuucugcagagacauuaugccacuguaaggugcauguacagaaaauaccucugagguugacuuguuaaauaacugaugaauguuauuucacacugaaucucaaagcagucauuuguuuugcggguuaggggaaaguuuuguuuuuugcugguguuuuuuguuguuuuuaauuaggcacacuaagaguggcuaaauuugggggaauugguggauaggaaagaccuugaaaagugauguguagaugaaaacacaagguauggauguugguuacagaguucaguuuuaacaagggaaauuuggggauuuuuuuuuuuuuuacuugcauguucuauggguagcuaucaaaggguguaacaaauuauuccagcuuuucccaauacuaauuauauugguuuuaaaaagucugcauaaucacuagguggcauuuucccuucauuugugaaccaagagggguaaaugaugcuacccauacagugacuucugaguucuuuaacuuugacagaaucuccauuguuucauugaauuucucauuguauuauaugucuuuccaagugugcaaacuauaauauguaguuaaugaaaaauggaaggcugcagauuauuuugcaugaauaauuaauugcccauuagggcuaaggagacugacaugauuuuuaucgguucuggguaaaugaaaauuuuaauggaaaacucauucaccauuuacuagcuuugugcaauauuauaaaagguagaagcaaaacacuagcacauugugcuuugcuuggcuuguaaggauggcuuuaguaccauuacauuaaauggacagugugcacaguguauuguaaaugccaacucuugcaaauuuacaauacuuaaauauguucaauuaacauccuaaaguauuaaaaguacagaggaaaaacuaagcaagcauuuauagcaauaccaugaaaucuccaguaaucguuuugacuguugccuuuugcucuuuagugcagcuuuucugcauuguaauuguauugcuuuguauuucauguuuuuuacacucaugacuucagaguuaaguacuuguacaccaaguauugcaaucaccuuucucuuguuguacaugcaauguaacaaccuacaguuuuggugcuuuuaacaauauuccucuuuuucuuuaauaaaggauauuuauuugaauuaauuaa

SEQ ID NO: 192447 - RNA, 60264 nt, Homo sapiens
acucggagcagcgcgcgccccgcaaucgccgcagccgcccccgccgucggccgccgcaccccaagcgacugcccaaacuaagccuccguggcuggguacgggagcgcuuuggggacaaaaauucucccucaacuguggucugcauuccuucggcccgugggcugaucuggggcgggaaguauuagcgucucaguugcgcugcagccggggaggaaggaggaggccgagccuggggcggaguuugggcugacuggggcuggaccgggcaagacgccgccgcugcccggauguugcgauggcugaucgggggaggccgagaaccgcagggacuggccgagguaaaccccgggugggucugcucugcguccgucgagcuugcuggaggggcggcuucguuccgguucggccuuccuggguuccgaccgcggggacccgggcggaggcggggcuggcugcugagcucgugccacgcgcuguucucacgacggugggggcggagggcgcgggagccggagcuccucagacccggcgggaccccaggcgcacccuggagcugcagacccccggccccgucccacggcuagcugaaucgugagauccuggcucagggacgcucagcuggucagcaguccuauugggaccugugacaacuuagggcuucuggcuaccgaaacuaucuucauuuccacuuaaaaaguauacgauuuagcuagaaacgaacgaguugugaccgcagcuuuccacuuuugguuuauuugaauuggugucucuuccuggcgucuacugauacuuggucagggaauauaaaauuaauuuacuuauccaacaaccgaaaaaggauauaauuauuuuuaaaaaguaaucugcuucaaggucaagaacaugauuuucuaauuaacugcuguuuuugguuucauagucacacuuucuucaugggcccgaauaauugaauagaccguguguaaugaaauuuacauuugaaaugugaauaaaauaauuuuugcagucuuggaaauuuugaggucccaaauuuauuucguaugccacacaagaacuuucaugcgcguccgugugaagagaccaccaaacaggcuuugugugagcaauaaaagcuuuuaaucaccugggugcaggcgggcugaguccgaaaagagagucagcgaagggagauagggguggggccguuuuauaggauuuggguagguaaaggaaaauuacagucaaaggggaguuguucucuggcgggcaggaguggggcaaggugcucaggggagcuuuuugagccaggaugagccaggaaaaggacuuuuacaagguaaugucaucacuuaaggcgaggaccggccauuuucacuuuugugguggaaugucaucaguuaaggcggggcagggcauuuucacuucuuuugugauucuucaguuauuucaggccaucugggcguauaugugcaagucaccggggaugcgauggcuuagcuugggcucagaggccugacaagaacagaauuugugaauugcauuuuauuucucauaagaaguauuuguuuagauuguuaaaaguaagaaauuggauuguugagaguaggcagucuucucaauuuuaacuuccgcaugucuuugcaguugacgguauugucuguuuuuaaaaauuucuuauuucagauuaauccuaaauccuugagauuguggauuauugaauagccauauaugguauauacgacauuuuggauaauucuguuuuaaccugguucuuugguuaaucauguuauuugcuuaaccaggucucccauuccuggcaaguuuucauuggaggagaagcaguuuauauaguuuucaaauuucucaccacaaucucuucuagaaggaagacagaauaaauacaaaaucaaugcuuugugguggugguuuuuuuuuuggaaaacauuuaugcauguuuuaaauuuauauauuucuucauauaaaucuaauugaguuguauaacugcugugaauuuguacauuaucggaaccuaugauugucccuaauuuaugcaauaacuuuguauccaggcuucucguuuaagcagugguucucaacuggggugauuuuugccccgcaggagacauuuggcaaugucuggagacauuuuugauugucaugccuugcagaggggcaguucuauuggcaucuaauguguauagaccagggaugcugcucaauguccuguaaugcacaggacaguucucaacaacaaagaauuaucugggcugggcgcgguggcuuacuccuguaaucccagcacuuugggaggccgaggcgggcgaaucacuugaggucaggaauucaagaccagucucgccaacguggugaaaaccugucucuacuaaaaauacaaaaauuaguugggcguguggugcgaaaaaaaaaaauucucuagcccaaaaugucagcaucaaguuugagaaauccagaguugauuucaugccuucauuuauucauuuagcaagcauguauugagugcuuguaauggaugaggcacuguuucacuauuuuaugucuuugauuugcaguuuuguuucugccacauuuuaacugagaaacaugcauucuaaaauguugaguuggauuggcccauuacuuuuuuuaaagugagguuuaauaggauacaauuuacauaaaauaaaauucacccuuuuuguaaauuuauugugauuugaaaauacuaaaauucaugauucgaauuugugguaggagaaguguuuuauguggaacuggcaguuauuuaguugauaaaagaagaaauaauauuuaguaguagaacaugauaccuuaaggcuuuuaaaaucuuguguucucagauguauaccauggaguuauauuccaauauggucuuacaaaucauuuuaucucuuuuuuugucuuuuguuuuuugcuuuuuuuuuuuuuucaauacaagaaaucuccuuuacagacaauaggugaagaacaaacccagaaucccuacacugaacugcuaguacugaaggcucaucaugauauuguacgauuucugguacaguuagaugacuacagguaagaagcuauaguggucuaauugacuauuguuugggaagagguuuuagggaauuuuauguuaaacaccuuuaaaauuaauacaucuuuucuaaaaauuuaaaaacugugaucauuaguaacauuuaguagaaauugaaauuggccucugcaucucgaugaaauauguaucuagagucuuuuuugcccaaagucagggugucgugucuggugauuugaggguuauguuuguuuguuugcauucucagaaauauucuuaauaguuuaaaagaaguguaugacuuuaaaauuuggguaggaguuauaacaguauauuaaggagaacuuguauuugagaaacaaauaugcuaaguguuuaaguaucagguaccuaccaggaauguuuuauuuuuaguggaagguaaguuuaauccaaaguuuuuguuauugaugaaaccacuugaaaauguacauuauucuguacuuccuugcuaacauguauaauaauuauguuuaauauauuugcaaauagaggugaagguguauaggcuuuaggacuguagacuauuacugauauguauauauguauauuaagcccauauucaacuguauaucuuuuauagcauguuucaccauaauaauuacauaauuagugguguaauucaauauuuucguccucucuaaaauguaagcuucaugagaaugaggcuauguuuuucuuauucaccauguuuucuuaguaccuaguacagugccuuacauguagcagauaauucauagaugguggcugagugaaugaaugacucuccagacuacuaagcauccacauugaaugccguccuaaucccccaaccucauuucuguugucucuacuaguuuuuccacuuucaucucuaauuuugucuuuugccuuugcuguuuuuuuucacuccauggaugaguguuacuguaauuauuccuaacucugaccaccacuucugcugucuauuaaccuugucuuuucucugcuuuuuuuuuuuuaauuuaauuuaauuuuuaaaauagagacagggucucacuauguugcccaggcuggugggcaacuccugggcucaagcugucuucccaccuuggccucccaaaguguugggauuacaggcaucagccaccgugcucagccuucucucugcucuuuaaauguuacugauauuuaguugcuuuaccaugugcagugcaguucugacauuaccuggacuuaggucagauuccacagaugaagggcauagucuauacagcaccccucacuggagacacuagcugcaagccauguauggguuuguaggccacuugcauuuccagcugcuggcuacaaguuccugcuguucccucaggucugauaauucacuagaaggacucacagaacugaggaaagcacuauacacaggauuacaguuuuauuauaaaagauacaaauuaggaccggccaaaugagaggauguauauagggcaaggccuagggggucccacaugcaaagcuuccaugucucaagacuccucgcccucuuggaacaucaguguguaucaccaaugaaugagcacacuugagcuuuggguguccagagcuuucauuaguaggcaugauuguuugaaucauuggucacauaauugaacucaaucuucaguccccacccuccccaccgugacugguagcagaaagcccaaaccuuuaaaucaugugguucauuuuuccaccuuggccagccccuuuccugauguuaucucagggcccacugugaguuguuccuuuaguauaaacuuaggugugguccaagggacccaccaugaauaaugaagacauucuuaccacuuggaaaauuccaaggauuuagagacucccuucuaggaaccagagacaaaguccagcaaaguuauuaaacaguaccaugcuucuuaacuuuugcuugaaaagauuugucucauauauauuacuggccugucaucacuguuuuccuguugugaugcaagucaaccaaaucauggcauguuaaacaaucaucugcagccuuuuuuuuggcaauguuacuuguugcuauguccugagagacacuccauuuauuaaaguggucauuuuuguggggaacuaauuauuucuggaaagguaagauuuuggacagcuaaaguuuucuugcgcuauauuuuacccuaguaaguugcuagauuaaagaaaaucugauaauuucuuauaaucacuaauacuuggguguuaaggaauccuaaaguuauuuuguccaggaaaguuaaauaauaaauacacaguaugugaucagguuguggacuuuaaauauuuguauaaauuguuaagagaucauguucauugcugucuuuccucugugaaauauccucuuggcuauuccuaucccauaguuagaagaggacucuguagaagaggccagccuauagaauaaugguuaguguacaaaugcugacauauauuugguuuaauuuuccccacaguggugcucacauauacuuuaguuguuuaaugauagaguaaauauucuguaaagaguaaaaagccauauguggguauguuaguuaccuauaugcucugucagcugucacaccaaacuuaguggcuuaacacaaccccaucuauuuagcucauuauucugcaggauggcaauucgggcuaggcucagcugggugagucugucuuugcaccaggagcaacugaucuuggcuagauucacuuaugccucugucagcugguagauuggcgggggcuggcugguucauuucagcugaaggucucagcugaaaugacuguggucucccuccaugugguuuuucaggugcuuguucacauaaugaucauggaguucuaauagcagcagaagggcaagccccaaaguaagacacuuuucaagucucagcuugccucguguuugcugcuguuucgucagccaaagcaaguuaggagcuggcacaaauucagugaguggguaaauaaacuugaccucucaugguagaaguaacuaaguccuauugcuaauggugguggcaauauugggagggggaauaauuuguggccaguuugugaucuaccacagugagucuaagauagaugaagaagccugcuuuuuggcuuuuguaauacagugaugauaugacuucaugauucacauuuaauucuuugaaaagucaucaaauuuacauauaaucaacuaugaaguuuuucggucauuugcugaccuguagaacuuucagucuguauguuguuuuuaaaaauuuaauucuguaguguacuaaaaaagaaaaaccgaaagagucaucuucguaagaaggacacaggaaaaucuacaaaguauaaacauuaugaacagaauuaaccgaauguuuuuacucuuaauaguuuagaauuaucuuuaccauugcauauguacauuaugcauugucaaauuagagaaauaccuuuccaguuuuaaaauuuuauaucauuauccuuuuuuuguuucuuaguuuuugaagacauuacacucuggguuuuuuuuggucagcuguuauaauccagguuucacgcuucaagucuuuagauaauaucaucuuauugaaaauuuugcagaaggauuuucuuguuuucucaguggcucagcuaaaaucagugaguggaaaauuuucucggauugguuuuugaagauacccaauaaauccuguauaaccuaacagacagcugccuuuucuuuucuucuuuaguauuuuuugaacaugaagugagggucguauugaugagagaucacuaaagaagguuaagccucagcaaaagucuuccaaaaaaugggcugugcuaaaauuucauguaauacucuagcguuugacacauuaaacuaaacugaguucauaacacauuuuaagaagaguuuucuccguugcucauuugaccauuccuugcuccuucaggaaacagacaagguuauguaggauggugaucaugacuggaaaggaaucagaugacccaugaugaagugccagauuggagaacaaaaugugccucuaggaugguuggugaagcuguacauucacaagaaaguaaauaaacucaguauagcuugauaauccacuaaaaaugaacaauaugcucauuuuaaaggaaauauucucaagcuaaacauauucuuucuuauacacuaaccuucagagaacagaaaucaguauaguuuagauccuaggaucuggguucccugggaaacagauagucaguauagauccuucuaguaccuggguucccugggaaggagacacuaaaauggagacacuaagcaugcaauagguuuauaagagagaaagccaaugaaaggagaagggaggaagcagaauuggauaaggggagcugucucagacucugaugcagaugugacaaaguuucugccagcccaauggggaccgcuggaggaaaggcugcuuuuuaagaguucucuacuggauguaaauaacuagggcuuuguacuauugccuugcuuaguuauuugcugaggguccuucaugaagaacaugcaccuggcuucuacuaucuugcuuaaaucccagugacuaggagccgauugagcuaguauaacuuuggcuugaaggcagaaauggauccugaagucaacagcuggaggcagucagauaacuauauuccucacagcugggcagugaguccugucuugaaagggggucuggaaggcagguauuggcgucugccacacuuccauaguuguaaguuggucuauuuuauuuuuaacuugcaugaacauacucauuggcuaugucuuugggcagcuuuuuaagaaacuguaaguaugccauugguuaauaguuauuugauggcuugaaaaaguuaauauuuuuagagcuauuaacguacuuaugccuggaaaaaaggguauaaccagaauccuuuuuaucacaaauuccagcagcuacaauauuaauaacagacuccauaucuggcauuuuuuuaaagcacuuauauccagugugacguugacuuuagacaacuuuauuauaguaaauuuuacuaaaaucuguuaaccaaauagcuuuucuauuucuaaaggccccuaauccaccauguguggugaauguguugauugaauuucuguuguuuugcaucgugcccugaaucaagcggggaauuucggcagugucaucacacagaugcgugugccacccuugcugcuuuucuccuuauuucuaauaauuuuguccuuucagcuuguguuuuggagcuguagcugaguuuuguuuaguuggauaagauguugcaggguuugggaggaugacaggagugagugaaacgguaauugcugcuucaugcauuagcauagaaucaaauuuuaggauaaggacagcaagugucuaacaguauuucaguuucaaauuugucaucuuagcaguaaaacucuaauuucuagauaaaaucagucucucucaacuacaaaauacccuuacucuaggcauuugaaaauuauuuucuugaacaucuuucaaauguagcuuuaaaaauccaucuggcaacuugagcauagauacaggaaguaacugcaaugaauugcaacauaucacauauguuuaaauccauguguucauaaugauacuuaaaaaagagaacucaccuuuggagaaugcuggggaacuaacucauucuguugaaaaucgguaaauaaaagggcagagucaaaaucuauacugccuuucuuauauaaacugugucuugggaucaguaauaauugacgagaagaaauuucucugaagaauucaagcuaggaagaaugauagaauuagaauauuguaauuuugcaaccucuaauguguagaggaggaaaacacuuuucuucuaccuaucuuagauucauugaucagggcucuacaacuuagacauacaaaagacagguuaaugagcgaaaaagaaguauaucaaugcauacguugcauacacacacacacacacacacacacacacacacacacacacacacgaguauucagguaacucguaggggugguuaaaacuugggcuuaggcugggcacggugacucagcccuguaauccuaacacuuugggaggcugagaugggaggauuccuugagcucaggaguuugaggcuagcgugggcaacauggcaaaaccaugucucuauuaaaaaauacaaaaauuagcugggugugguggugcacaccugugguccaagcuacuugggaggcugaggugggaggaucaccuuagcucaggagguugaggcugcagugagcugugaucggggccacugacuguagccuggaugacugaguaagacccugucucaaaaaagaaaaauaaaacuucagcuuauauagcaucuuagcagaacaagaaauuuguugagugacaagacaaaggaaauggacuuugaguuucuugggguggcaaauugugagaaggcaaauauaugauggaaacugcugguagagaagggcucauuagugagguugguuuguguaaacucuuggugccaucucaucugugauaaagguuguuaucccccuccugguaugggaguggggguggagguuccgggggcacuuucccaagggugaugugugcuuuuuuuuuuuuuuuuucagguagauguggggaggacagagcucauucugugccugcauuuucucaguugccuuaagcugaaaauaaucauuaugucagaguggcauaguuugggguuaugugcucugaaccccuucaaaugaaauaaugaauuuagauggccuaaaucauaacauauacacauacacacacaagauagccagaaauuauauuuccggauggaguauacaaucugccuuugggguggucuuaccaaaaagucagauauggaucuuauuuagucucuagauuuaacuaucaauuaacaaaaaauacagaggacagaggugcauguuggauaacagcacaggaaaaaaaacccagacugugagaacucgacaagacaggugaauuuuuuuuucaacaaauaaauugcaaggaaaaacagauggagaaaaaaaucauuagaauaaaagagauauuagagauaaaucaaccaaguguacuauagaagccuuauuuggauccuucuaacuguuuaaaaaauuacgaucagcuaaauuugaucauugacuggguauuugaugacauuaaggaaguaaauguuaacuuaggugugauguaaaagaguccuuagagaugcauucugaaauacugacaaaaugaaauacagugacuaggauuugcuucaaaauaauuuacagagggguuggacugggugcagauaagacacuaguggccauaaauugauaauuacuagagacaggcaaugaguacauguggcuuuuuauuauaaugcccuucucuccacuuuuguauauauuuaaauucuccguaaugaaaaguuaacuaucuguauuugaaauagaggaaauaaaaaugccaauuuaaaagguauuuaugccucugugaaauaaaauguuuucuuagauauugcuaguguucugaguguucaguggagaaccacccuuguuucucuuugagaacagaauuuauugagaauaguuguaggaaucauacagaugaacaugaacauaucagcuucauaaaguaauaaccgauacaaaacuggauuaccagauauggcucuuuuuuuuuuuuuuuuuuuuuuuugagacggagucucgcucugucgcccaggcuggagugcaguggugugaccuugguucacuccaaccaccgcuucccagguucaagcgauucuucugccucagccucccgaguagcugggacuacaggcaugugccaccacaccgagcuaauuuuuguauuuuuaauagagacaggguuucaccauauuggccaggcuggucucgaacuccugaucucguguuccgccugccucggccucccaaagugcugggauuacaggugugagcuaccaaacccagccaggauguggcuuuaauauguacccacaguggauuuccuuaacacuucacccugagucaaguagacuauuucaaugaaucccuggggcaacugaagaguugccagccucccauucagauacaggcuuaccucaaaaauaagagcagaccaguauguucccucucugugaacagaugaaucuucagaaaacccacaaggggccggguaugauggcucaugccuguaaucccagaacuuugggaggccaaggcggguggaucacaagguaaggaguuugagaccagccugcccaacauggugaaacuccaucucuacuaaacauacaaaaaucagccaugcguggucgugggugccuguaaucccagcugaggcaggagaaucguuagaaccugagaggcagaaguugcagugagcugagaucacgccauugcacuccagccugggcaacagggcgagacuuugucucaaaaaaaaaaacaacccagaaaacccacaagggucugaacugagcaugccuaauucauugucucaagcaaguggggcagagagagaccaagaauguuucucuaguagugggaguccuccauggaaacuugagugcaggggaauggagguucaccuaauagaagucacacagauuuuuuugguauucuaauacuguaaucuuuuuuuuuuuuuuuaauuauacuuuaaguuuuaggguacaugugcacaaugugcagguuaguuacauauguauacaugugccaugcuggugcgcugcacccacuaacucgucaucuagcauuagguauaucucccagugcuaucccuccccccuccccgcacccuacaacaguccccagagugugauguuccccuuccuguguccauguguucucauuguucaguucccaccuaugagugagaauaugugguguuugguuuuuuguucuugcaauaguuuacugagcaugauguuuuccaauuucauccaugucccuacaaaggacaugaacucaucauuuuuuauggcugcauaguauuccaugguguauaugugccacauuuucuuaauccagucuaucauuguuggacauuuggguugguuccaaguccuugcuauugugaauagugccgcaauaaacauacguaugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaagaguguaaaaguguuucuauuuccccacagccucuccagcaccuguuguuuccugacuuuuuaaugaucgccauucuaacuggugugagaugauaucucauugugguuuugauuugcauuucucugauggccagugauggugagcauuuuuucauguguuuuuuggcugcauaaaugucuucuuuugagaagugucuguucauguccuucgcccacuuuuugaugugguuguuuguuuuuuucuuguaaauuuguuggaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguagccauugcuuuugguguuuuagacaugaaguccuugcccaugccuauguccugaaugguaaugguuagguuuucuucuaggguuuuuaugguuuuaggucuaacguuuaugucuuuaauccaucuugaauugauuuuuguauaagguguaaggaagggauccaguuucagcuuucuccauauggcuagccaguuuucccagcaccauuuauuaaauagggaaucguuuccccauuucuuguuuuugucagguuugucaaagaucagauaguuguagauaugcggcguuauuucugagggcucuguucuuuuccauugaucuauaucucuguuuugguaccaguaccaugcuguuuugguuacuguagccuuguaguauaguuugaagucagguagugugaugccuccagcuuugcucuuuuggcuuaggauugacuuggugaugcgggcucuuuuuugguuccauaugaacuuuaaaguaguuuuuuccaauucugugaagaaagucauugguagcuugauggggauggcacugaaucuauaaauuaccuugggcaguauggccauuuucacgguacugauucuuccuacccaugagcauggaauguucuuccauuuguuuguauccucuuuuauuucauugagcagugguuuguaguucuccuugaagagguccuucccaucccuuguaaguuggauuccuagguauuuuauucucuuugaagcaauugugaaugggaguucacucaugauuuggcucucuguuuguuguugguguauaagaaugcuugugauuuuugcacauugauuuuguauccugagacuuugcugaaguugcuuaucagcuuaaggagauuuugggcugagacagugggguuuucuagauauacaaucaugucaucuacaaacagggacaguuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacgucccauccauaccuaauuuauugagaauuuuuagcaugaaguguuguugaauuuugucaaaggccuuuucugcaucuguugagauaaucaugugguuuuugucuuugguucuguuuauaugauggauuacauuuauugauuugcguauauugaaccagccuugcaucccagugaugaagcccacuugaucaugguggauaagcuuuuugaugugcugcuggauucgguuugccauuauuuuauugaggauuuuugcaucaguguucaucaaggauauuggucuaaaauucucuuuuucgguuaugucucugcccggcuuugguaucaggaugaugcuggccucauaaaaugaguuagggaggauucccucuuuuacuauugauuggaauaguuucagaaggaauuguaccaguuccuccuuguaccacugguagaauucggcugugaauccaucugguccuggacucuuuuugguugguaaacuauugauuauugccacaauuucagauccuguuauuggucuauucagagauugaacuucuuccugguuuagucuugggaggguguaugugucgaggaauuuauccauuucuucuagauuuucuaguuuauuugcguagaggugucuguaauauucucugaugguaguuuguauuucugugggaucaguggugauauccccuuuaucauuuuuuauugcaucuauuugauucuucucucuuuuuuucuuuauuagucuugcuagcagucuaucaauuuuguugauccuuucaaaaaaccagcuccuggauucauuaauuuuuugaaggguuuuuugugucucuauguccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugugucccagagauucugauauguugugucuuuguucucguugguuucaaagaacaucuuuauuucugccuucauuucguuauguacccaguagucauucaggagcagguuguucaguuuccauguaguugagcgguuuugagugggauucuuaauccugaguucuaguuugauugcacuguggucugagagauaguuuguuauaauuucuauucuucuacauuuccugaggagagcuuuacuuccaacuauguggucaauuuuggaauaggugugguguggugcugaaaacaauguauauucuguugauuugggguggagaguucuguagaugucuauuaggucugcuuggugcagagcugauuucaauuccuggguauccuuguuggcuuucugucucguugaucugucuaauguugacagugggguguuaaagucucccauuauuauugugugggagucuaagucucuuuguaggucacucaggacuugcuuuauucaucugggugcuccuguauugggugcauauauauuuaggauaguuagcucuucuuguugaauugaucccuuuaccaugauguaauggccuucuuuaucucuuuugaucuuuguugguuuaaagucuguuuuaucagagaguaggauugcaaccccugccuuuuuuuguuuuccauuugcuugguagaucuuccuccaucuuuuuauuuugagccuaugugugucucugcacgugagauggauuuccugaauacagcacacugaugggucuugacucuuuauccaauuugccagucugugucuuuuaauuggagcauuuaguccauuuacauuuaaaguuaauauuguuaugugugaauuugauccugucauuaugauguuagcugguuauuuugcuuguuaguugaugcaguuucuuccuagucucgauggucuuuacauuuuggcaugauuuugcagcagcugguacugguuguuccuuuccauguuuagcacuuccuucaggagcucuuuuagagcaggccugguggugacagaaucucucagcauuugcuugucuguaaaguauuuuauuucuccuucacuuaugaagcuuaguuuggcuggauaugaaauucuggguugaaaauucuuuucuuuaagaauguugaauauuggcccccacugucuucuggcuuguagaguuucugccaggagauccgcugugagucugaugggcuucccuuugaggguaacccgaccuuucucucuggcugcccuuaacauuuuuuccuucauuucaacuuuggugaaucugacaauuaugugucuuggaguugcucuucucgaggaguaucuuuguggcguucucuguauuuccugaaucugaauguuggccugccuugcuagauuggggaaguucuccuguauaauauccugcagaguguuuuccaguuugguuccauucuuccugucacuuucaguuacaccagucagacguagauuuggucuuuucacauagucccauauuucuuggaggcuuuggucauuucuuuuuauucuuuuuuucucuaaacuucccuucucgcuucauuucauucauuucaucuuccaucgcugauacccuuucuuccaguugaucgcaucggcuucugaggcuucugcauucuucauguaguucuggagccuugguuuucagcuccaucagcuccuuuaagcacuucucuguauugguuauucuaguuauacauucuucuaaauuuuuuuucaaaguuuucaacuucuuugccuuugguuugaauguccucccguagcucauaguaauuucaucgucugaagccuucuucucucagcuugucaaagucauucuccauccagcuuuguuccguugcuggugaggaacugcguuccuuuggaggaggagaggcgcucugcuuuuuagaguuuccaguuuuucugcucuguuuuuuccccaucuuugugguuuugucuaguuuuggucuuugaugauggugauguacagauggguuuuugguguggauguccuuuguguuuguuaguuuuccuucuaacagacaggacccucagcugcaggucuguuggaguacccggccgugugaggugucagucucucccuucuggggggugccucccaguuaggcugcucgggggucaggggucagggacccacuugaggaggcagucugcccguugucagaucuccagcugcgugcugggagaaccacugcucucuucaaagcuaucagacagggacauuuaagucugcagagguuacugcugucuuuuuguuugucugugcccugcccccagagguggagccuacagaggcaggcaggcaggccuccuugagcuguggugggcuccacccaguuggagcuuucuggcugcuguguuuaccuaagcaagucugggcaauggcgggcgccccucccccagccuggcugcugccuugcaguuugaucucagacugcugugcuagcaauuagcgagacucugugggcguaggacccuccaagugaggugcaggauauaaucuccuggugcgccguuuuuuaagcccgucggaaaagcgcaguauuagggugggagugacccgauuuuccaggugccgucugucaccccuuucuuugacuaggaaagggaacucccugaccccuugagcuucccgagugaggcaaugcgucgcccugcuucggcucgcgcacggugcacgcacccacugaccugcgcccacugucuggcacucccuagugagacgaacccgguaccucagauggaaaugcagaaaucacccgucuucugcgucgcucacgcugggagcuguagaccggagcuguuccuauugggccaucuuggcuccuccuccuacuguaaucuugauguguaguuuagcuuucuaucugugauuugggaagggaagaacuuaccaaauguuuuaccuuugcaaauaaccaugggaacuaugcaaucuuuguuugugagcuaaaaaaggaccuuagacuuuuagauguuagagucauguuaauauaauacauucuuuuuuaaggaaaagaaauuguugaaguagaucuaauuaaggaauugguugcgucagcaucuauggcuccugaaaaugcuuugacguuuccuucaacuccuuuacaagucccuaucuggaugcuucucuaauuuucuucaaguaguucuagcauacaaacauauacuuuaaaugaaaauugugauuuuuuuuguuguuauacuuuaaguuuuaggguacaugugcacaaugugcagguuaguuacauauguguacaugugccauguuggugugcugcacccaguaacucaucauuuuaacauuaguuauaucuccaaaugcuaucccuccccacuccccccaccccacaacaggcccuggugugugauguucuccuuccuggguccauguguucucauuguucaguucccaccuaugagugagaacaugcgguguuugguuuuuuguccuugccauaguuugcugagaaugaugguuuccagcuucauccaugucccuacaaaggacaugaacucaucauguuuuauggcugcauaguauuccaugguguauaugugccacauuuucuuaauccagucuaucauuguuggacauuuggguugguuccaagucuuugcuauugugaacagugccgcaauaaacacacgugugcaugugucuuuauagcagcaugauuuauaauccuuuggguauauacccaguaaugggauugcugggucaaaugguauuucuaguucuagaucccugaggaaucgccacacugacuuccacaaugguugaagucccaccaacaguguaaaaguguuccuguuucuccacauccucuccagcaucuguuguuuccugacuuuuuaaugaucgccauucuaacuggugugagaugguauaucauugugguuuugauuugcauuucucugauggccagugaugaugcgcauuuucucaugugucuuuuggcugcauaaauaucuucuuuugagaagugucuguucauauccuuuacccacuuguugauaggguuguuuauuuuuuucuuguaaauuuguugguguucauuguagauucuggauauuagcccuuugucagaugaguagauuacaaaaauuuucucccauucuguagguugccuguucacucugaugguaguuucuuuugcuuugcagaagcucuuuaguuuaauuagaucccauuugucaauuuuggcuuuuguagccauugcuuuugguguuuuagacaugaaguccuugcucaugccuauguccugaaugguauugccuagguuuucuucuaggguuuuuaugguuuuaggucuaacauuuaaguguuuaacccaucuugaauuaauuuuuguagaagguguaaggaagggauccaguuucagcuuucugcauaugacuagccaguuuucccagcaccauuuauuaaauagggaauccuuuccccauuucuuguuuuugucagguuugucaaagaucagaugguuguagauaugcggcguuauuucugagggcucuguucuauuccauuggucuauaucucuguuuuugguaccaguaucaugcuguuuugguaccaguaucaugcuguuuugguuacuguagccuuguaguauaauuugaagucagguagccugauaccuccagcuugguucuuuuggcuuaggacugacuuggcaaugcgggcuguuuuuugguuccauaugaacgugaaaguaguuuuuuccaauucugugaagaaagucauugguagcuugauggggauggcauugaaucuauaaauuaccuugggcaguauggccauuuucacgauauugauucuuccuacccaugagcauggaauguucuuccauuuguuuguauccucuuuuauuucauugagcagugguuuguaguucuccuugaagagguccuucccaucccuuguaaguuggauuccuagguauuuuauucucuuugaagcaauugugaaugggaguucacucaugauuuggcucucugucuguuauugguguaaaagaaugcuugugauuuuugcacauugauuuuguauccugagacuuugcugaaguugccuaucagcuuaaggagguuuugggcugagacaaugggguuuucuagauauacaaucaugucaucugcaaacagggacaauuugacuuccucuuuuccuaauugaauacccuuuauuuccuuccccugccuaauugcccuggccagaacuuccaacacuauguugaauaggaguggugagagagggcaucccugucuugugccaguuuucaaagggaaugcuuccaguuuuugcccauucaguaugauauuggcuguggguuugucacagauagcucuuauuaguuugagauaugucccauccauaccuaauuuauugagaguuuuuagcaugaagaguuguugaauuuugucaaaggccuuuucugcaucuguugagauaaucauaugguuuuugucuuugguucuguuuauaugcugaauuauguuuauugauuugcguauauugaaccagccuugcaucccagugaugaagcccacuugaucaugguggauaagcuuuuugaugugcugcuggauucgguuugccaguauuuuacugaggauuucugcaucaauguucaucaggguuauuggucuaaaauucucuuuuuugguuaugucucugcccggcuuugguaucaggaugaugcuggccucaugaguuaaggaggauucccucuuuuucuguugauuggaguaguuucagaaggaaugguaccagcuucuccuuguaccucugguagaauucggcugugaauccaucugguccuggauuuuuuuuugguugguaagcuauuaauuauugcgucaauuucagauccuguuauuggucuauucagagauucagcuucuuccugguuuagucuugggaggguguaugugucaaggaacuuauccauuucuucuagauuuucuaguuuauuugcauagagguguuuuuaguauucucugaugguaguuuguauuucugugggauugguggugauauccccuuuaucauuuuuuauugcgucuauuugauucuucucucuuuucuucuuuauuagucuuacuagcguucuaucaauuuuguugaucuuuucaaaaaaccgguuccgggauucauuaauuuuuugaaggguuuuuugugucucuauuuccuucaguucugcucugaucuuaguuauuucuugccuucugcuggcuuucgaauguguuugcucuugcuuuucuaguucuuuuaauugugauguuagggugucaauuuuagaucuuuccugcuuucucuugugggcauuuagugcuauaaauuucccucuacacacugcuuugaauguguccuagagauucugguauguugugucuuuguucuuguugguuucaaagaacaucuuuauuucugccuucacuuuguuauguacccaguagucauucaggagcagguuguucaguuuccauguaguugaacgguuuugagugaguuucuuaauccugaguucuaguuugauugcacuguggucugagagacauuuuguuauaauuucuguucuuuuacauuugcugaggagugcuuuacuuccaacuauguggucaauauugaaauaaguguggugugaugcugagaagaauguauauucuguugauuugggguggagaguucuguagaugucuauuaggucugcuuggugcagagcuaaguucaauuccuggauauccuuguuaacuuugucuuguugaucugucuaauguugacaguaggguguuaaagucucccauuauuauugugugggagucuaagucucuuucuaggucucuaaggacuugcuuuauucaucugggugcuccuguauugggugcauauauauuuaggauaguuagcucuucuugugaauugaucccuuuaccaugauguaauggccuucuuugucucuuuugaucuuuguugguuuaaagucuguuuuaucagagaguaggauugcaaccccugccuuuuuuuguuuuccauuugcuugguagaucuuccucuaucccuuuauuuugagccuaugugugucuccgugcaugagauggguuuccugaauacagcacacugaugggucuugacucuuuauccaauuugccagucugugucuuuuaauuggagcauuuagcccauuuacauuuaagguuaauauuguuaugugugaauuugauccugucauuaugauguuagcugguuauuuugcuuguuaguugaugcaguuucuuccuagccucgauggucuuuacaauuuggcauguuuuugcaguggcugguaucgguuguuccuuuccauguuuagugcuuccuucaggagcucuuuuaagacaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccauuaucuucuggcuuguagaguuucugccaagagaucugcuguuagucugaugggcuucccuucguggguaacccgaccuuucucucuggcugcccuuaacauuuuuuccuucauuucaacuuuggugaaucugacaauuaugugucuuggaguugcucuucucgaggaguaucuuuguggcguucucuguauuuccugaaucugaauguuggccugccuugcuagauuggagaaguucuccuguauaauauccugcagaguguuuuccaacuugguuccauucucccugucacuuucaguuacaccaaucagacguagauuuggucuuuucacauagucccauauuucuuggaggcuuuguuucuuuuuauccuuuuuuucucuaaauuucucuucucacuucauuucauucauuugaucuuccaucacugauacccuuagcauuuuuucaauguuauuuuauuguaaauguaauaaugacuucaggcagugauuauugauggguguuaacaucacacacacgcaaaaaugacugccagaaauuuguuuccuaauggaguauacaaacugcuuaugaaauggucuuaccaaagagucagauuugaauuggauuaagucuguagauuuaaggaucaguuuucuaaaaauacagaauacagaggugcauguuagaugacaacagaggaaaguagucagcaaaaucugggcugugagaauuauacaggagagacaacuaggguacaugugcacaacaugcagguuuguuacauauguauacaugugccguguuggugugcugcaccgauuaacucaucauuuacauuagguaugucuccuaaugcuaucccuccccccuacccccaccccacgacaggcccuggugugugauguuccccuuccuguguccaaguguucucauucuucaguucccaccuaugagugagaacaugugguguuugguuuuuuguccuuggcgauaguuugcugagaaugaugguuuccaguuucauccaugucccuacaaaggacgugaacucaucccuuuuuauggcugcauaguauuccaugguguauaugugccacauuuucuuaauccagucuaucauugauagacauuuggguugaagagagacaacuuuuuucaacaaaaagauugcaaggaagaaaaagauggagaacaaaaccauagaaaaaagagacuuuagagauauaucaagcaguugugcuauauagaccuuauuuagauccugcgucuuacuguacaaaaaaaaugaugagaugaucauggaaacuguauaguauuuuaguuuuaucaugcauuagaaaguacuugcagguuagguggaaaguuaaccacuggggugccuguacugccauaauaaugucguauuaagauuuuuauuuuuucagugccuuauguagacauugaauacaggaagauuuaugguucagguuuauggacuauacuuuuuauguccuuuaagguaacauuugaauuuuugggaccuucacuuaguugaaaggccuucacaugaguaagaacuauuaaaugagcauuuagcuauuggacauaagaauuauugugaaaacaauuuauuuuuuacaaaucuuuauuaagcuuugcuguaguuuucagcccacuguuggaaggaacgagagaauacuuucucagagauguucaaagagaagauguuuagagggaauuauuuuuauacauuaagaugguuguaagugagaauucucuaaggacucaugaucuagacccuauagcaucacaugguaauguuggacugugaguucuugaauggcaagaacaaucucuugaucuuuauucuuagguuuaagcaucuauauaguuagugcuuaguaaguauugaauuaccgagugacuuauggacuaucauaauaaauuuaguucucauaauuaggggaugagaggaugaaacauucuaggaggucugccauaggucuuuguuaaaccauguuucaccuuguugaacuuguuuuucaugaauguaaguuuugcuuagucauuuaauuguguagucucaaggaguauuuuuaacaacuuggguuuuuuuuguuuuuuguguuuuuuuugagauggagucuugcucuguuguccaggcuggagaguggugugaucuuggacuugguuuuaaguuaaagaaaaaaccugaaguauauggauaagaauuggacaggaauaugaaaaaauauagaaauuuauuuuugugugguagggauucuggguuuuaaauuuuuaaguuucuauuuuuugugguaguauauuuacauuaauuaugauaaaaggaaaauaugggguuacauugccaucauuaaucaaucuauuucacagagcccuugaacacuuaaauguuugcuuaugcauucacuuauucauucaacaagcauuucuuuagcacuuaaaaccugccagagauaaucagagauucauuagacuggcaagugccauguuauaaagauaaagaucaauaaauaugguaauucuuagaguucaugauucuaagaagcauauuuuuuucuauuuugacaucucuaaaauuuggacacaucauauaauuguguguuucaauuguaauuggcaguauguuuuccuuaaugguaaauaaaauaagagugucuuacaauugaugucuuagauuugaugaaauacgguacauuucuaaacaaucauaaaguuuuaagaucucaaagcaagaaccacauguaaggugucuucacauuucccuaacuccuagcacggaaucacacugaauacauuuuuugcuaaucgguaaagaaacauuucucucaaaaucuuaucuuuaggcuuaaguuuuugcuuucuguuacuuuagaauguuuuuaaaaauuaguauguaaaauguuaucuggcaauauuacuauucuuccauuggauagaauagcuuaaacuuuauugacauuuuaauccuuuuuuuauuuuauaguucauuacuucuuuucagcaguuacacuauaccuuacaauuaggaauucuuggguuguauuuccauuucugauuuggagaugguugaaguguaugcuugacugacuaggauuuaguuuaagauaaacugauaaaguauagcuaguuuuuuguuauccaucauaauaggauggguaauuguaauuugugaaugauaucucaacccuuuauuaguuuuuuuaugacagguacuaauaugugucaaaguuauacugguuuguauuuuaaagcuuaauguuuccucuuuaggggagguaguaauaaauacugaaauggcaaaaaaaaaaaaaaaaugguagcaauagaauauauauaagaauagaaggccugaauaaucuaccaaccagguaauugaccuugcagcaauaaaaaauugacugugauuucaugcauuacuauugagccuuauuuagauuuaacuuuuguucccuacugauugaauuaaaguuugagguuaaaugcucuauaucccauuucuaaacucucagcuguucucagucaucucucauugugaacucaugaaagucaaacaugauaaaacaaucauaagaaguuaaaaauuaggguuagaaaaaaaguauguauuuuaaacuugcugucuucuaaaugcaauuuuaaguuuaaagaaucaauagaaauugauguuuuauaccaaagaacacuuaagaccuugaguccugcccuccccaccaucacuauacaaauaaaaagaaaucaauaggcccagaaacauaagcugcuaaagauuuauuuccagcaacuauuuuugauauucaagguacuauuuacuaaucugauugagaaaauguagauaauuaagcauaggaaaucuauuuuuauuuuaaaaaugaucauuuucuuuuuaaucuccggaucuuuuauauguuacauuuuaaaauaagaauaaaugauaggcauggauuuaaaaauaacucuuugugauuuuuagcuaguuaccuaaauuuaacagguccauucuguuaaaaagauagguaguucuguauuuaaaaauuauuaaaagacugucagacuguauuugaucaauuucaugucuccugaauaaucuugguucuaccaguaguagauguacucaaaggauuuugaaauaagaacugaguauuggaauugucugagccagugaaggcacugaacuuugaaacugaagauaagaaauuugaacaugaaacucaguuuggaguguuaaggaaaguauuucaugacugaaauagugggauuuuguuaucucauaaagggguaaaaaauccauuagaacagaugcucacauagcaucuguuaauuauaaggggccaguuauaugucauucauagcuggcucucuuuaacaccacuucuuucucucauacugaaaaaaaaaaaaagccugaauuugagugaaagcaauauuauggggacaacuuuaaauugauucugagucauuaaaaauuauuuacaaacuuguggaugacauuaacaguaaauuauuugacaugcuuaugaugugauuauuuauacuacuuuguugcguuaguauaauaagauggugaauuuuaguauaauauggugaugaauaauccuguaugacagguuauuccuuuugauaguguuuauguucagaauaucuucuacucuacagaauuuggugauugucccugugauauggugaaugggauauaaaaaggagagagaagcuauagcagacuaucacagcucauuuuucaugccauaagacaagcuuuaccugugcauuucaagcaucuucacuaaaaagcaacaaaaaaacccuaaaaaauccucaaaucuuccaaaccaagaacaaagcauuuauguggaaagacuaaggaguugagcugagcaaaagagagaucuugacuuuaaauaauaauuauuuacagagagaauaauagaaguaaugaauuuauuuaacaucguaaucacuuccuagaauaucacuuccugucacugaaggcacuugucagcuugguuucauuucacuuaagucagggauuucuuaaaaucauagaauuuuaaagcaaagaaggacuuuaaagauuauuuuuacauuucuagcaguuuauucuuuguaaacuuauaaaugucuuauuuaucuuuugaucuuccauaccugguacagaagcuggaauguguuucauaaauauuuuuuaaauuagcugaaauaacuugaucuucguuaauauuagucaaaauaccacuaauaagguuugauaguucuuaaucuuaguaauuaaaugucaccagugauuuuuuuuucuugacccuuucucccuaaccagauuugcaucugcuggugaugauggaauuguaguuguguggaaugcccagguguguauugauuauguguggauugugugauaaagauaugaugauguaguugaguauguauucauauaaauacuaucuggggauacauuuacauaucacuguuaauugacacauuaauauuugaaaagagcuaauuaggauaaauccauauacaguggggaccaguauuucauaaugaagagggaaaguuuuuuuaaauugagauuuuuuuuccagcugggugugguggcucgugccuguaaucccaggacuuugggaggccaaggcgaacggauaacuuggggccaggaguuugagaacagcuuggccaacauagcaagaccccgucucuacuaaaaauacuagaaaucagcugggcauaguggcacaugccuguaaucccaguuacucgggagacugagguugcagugagccgagaacaugccacugcacuccagccugggugacacagcaagacugucucaaaaaaaaaaaaaaaaaaaaaaaguuuuuuccuaagaaacaaaugccaaaguaugaaaauucaaaaaauacaaaauuuuaaucuuauuuaacaaaauuuagguuaucacuagcuaugcccugacuuccaaaaugaauaaaugaauuguguugauuuuugugagacacacaaguuuucuuucaacauugcguaauagcauaauguaacauuuuucucauguuugacuuaauauuacaaaagccuuuuuuuuuuaaauaaauacuuaaggcuucaccaguuucuucagagccucccuuccugaucauuuguuacucaaauuauucuuuuuugaaguaucuuccucucaccuuaauuuuggauuguuaucuagucugacugugucagaucuuuauuuuucaauggcuuugccugugauaaaaucaguucuuuaacauuauuuucaccacauucacgaaguccugcaaucuuggaaagauuugccauuuacauuguauuuuugcauguuuacuacuugguaaauuagucagagacugauggaugaagacacuggauggguaggaauagauguugguguuaaauaacgauggaguggagacugacuuucuaagugguuaauaaaugaguggauauauauacuuauuuguguguagguacauauacaguuguuauggugacuuuuauuuucuucuaugaccuuauaacuguggagacuuaaauaacaaauacuuggacaaugaggacuccauauuuuuuuccugcaaacuaaguuacugauguuuuuaugcuuaauuuacacaauuauauuuuuaaauuuauagaaaaaaauacucaaaauuuucuauaaaaauauacuaaaaauuagcauuuuguuuuagaaaauaaaacuauaguuauggcuguacuuucagugcuuguuuagauucugugugauugcuuaaguuaaauucugaauaaguaauuuuaaauggaauguauauguaucuucuauaugguaguuguacuuaauguagucauuuaugauuaucuaaauugugaaagcuaagccuauuaacauuuuuauugguauuucagacaggggaaaaacuuuuagaacugaauggacacacucaaaagauaacagcuauuauuacauuuccuuccuuggaaucuugugaagagaaaaaucaacucaucuugacagccucugcugauagaacaguuauuguauccuuuaaucuggaagaaaugaacaagcuguaguggccuaaggagccacuacauacacuauuagucuuuagcugauagggucuugucuguauauucuuguuauagcaaaaaugauuuuuguucuguuacuuauaagauaccauuuauuagguaucugaaaaguauuagacuggaaauaggagguuaaggcuuguuauugauggaaacuccgugacuauugcuguucuuuccagaguuacucuaucagguuguauaaaauugaugaaaugggaaaauguggacuuaaaaauaauuuauuuuacuaucucaguuugcuuuucaauuuagggaaacaacgaugaguuggacuggagaauaauuuacauuuuuuuuccccacuauacagcagaagaaaccaaauggucccaacccauaaaaaucuuuggagcaucugagucugauagaaaagugaauuacuguuuguucaguguguaauauuuaauaauuaaaaacaauuuuauaaaaguaaaauuacuuuuucuuuacccauacuuuuagguaaaaaguuaagaugggauagcaguaguaaagugcuuauguguaacaggcauuguucuaauuguuuuacauauauuaacucauuuaaucuuuaaaauuagcccuuugacauagguauuuuuaauucuuuuuuuuuuuuuuuuuugagacggaguuucacucuuauugcccaggcuggagugcaauggcgugaucuuuacucacugcaaccucugccuccuggguucaagcgauucuccugcuucagacucccgaguagcugggauuacaggccugugccaccacgcccagcuaauuuuguauuuuuaguagagaugggguuucacucuguuggucaggcuggucucgaacuccugaccuuaggugauccacccacccuggccucccacaaugcugggauuauaggcaugagccacugcgcccggccuuauuuuuaauuauucuuauuuacagaugaaaaaaauagagucacacagaggcuaaguaacuuucccaaggcacacagccaguguagggcagaacuggcaagucugacugcagagucagagccccgaaccacugcacuucauaaaauguuuucuguaaacaaacucagcccuuuaauaucuguaugaggaauuggcuuggugaaguccagagucaagugcuauggauaacuguugucuuucauuacuuuuauuuuuuuaaaagagguugucagauuaauuuuuuuuuuuuuuuagacagaaucucacuguugcccaagcuggagugcaguagcacaaucucggcucacugcagccuccaccucccagguucaagugauucuucugccucagccacccaaguagcugggacuacaggcgccugccaccacguccggcuaauuuuuuuguauuuuuaguagagacgggguuucaccauauuggccaggcuggccucgaacuccugacuucgugaucugcccgccuuggcaucccaaagugcugggauuacuggcaugagccacuguuuccggucauauuaauuuuuaaaaguauaugcuuaucugaaaguucuguguaaacacuuucaagcauuggugaaguuuuggaguaagcccaaaaguauagguguuucuuaggcucuuacagaaccaagauacagacuugaacaugcuuuaaaugaguucaucaacugaagugcuuucuagacagauuguucauagcugaaaaaaugucaagaaaagguuuaaauggggauaaacucucuauacauacauacauauauacauacacacauauauguauguuugugugugauuaugauacaauguaaacaagggcauaaaauucucucagaugguuaggucagaguugcuuuauuacuacucuguagaggcaaauaugggauaaagcucucuuuuucaguaucaguguaaucuuugcaaaaauagaauuuaaaauacucuauuagaccacuccuaagacacuauagcaauauuuugaggcagugauuaaaauuacauacagaaguuaguagcugguacagugucacuaugaauuuuaccuguaaaugauaguauggacucauuuccuuugcugagugauuuuuguuguuagaaaaaaauucuaggccgcuuauuuggcagucucucuuacccaaaugaauucuaaauuuacucugcuuggguuuuuacuacagguugagcaucccuaaucugaaaauccaaaaucugaaaugcuccaaaauccaagaccuuuuaagcacugacgugaugccacaaguggaaaaucuuauaccugacaucaugugacagguugcagucaaaauuuuguuuaacgcacaaaauuaccaaaaauauuguauaaaacuaccuucaggcuauauguauaagguguauaugaaaaauaaaugaauuuuguguuuagacuuggguucaguccccaagauagcucauuagguauaugcacauauuccaaaauccaaaaaaaaucagaaacacuucuggucuuaagcauuuuggauaagggauacccaaccuguaaaaacuaacuuccuuaauuaaauacugaagguagauaauuuuuuaaagcgauagccuuaggagcucagguuacugaauauuaaauguucugcuugugaauagugaaauaagugaaaaggcugugagauacuacuagaauucugguaaauauaaggccagaaaacauuuccuaauuacugggagcauuuuuuguaugcuagcaguuuuaguguguuauauacauaaaauguaauucucaugauaaucuagcuccaucuaaagcaugacauagaauauagaugguccccaaccuagggugguuugacuuacaguuuuucaacuuuaugauggugugaaagggaggugcauuaaguagaaacuguacuuugaauuuugaagucugauauuuucucacacuagugaugcaugggaugauagucuuucccagugcugggcagcagcagccuggagcugcagcuccuuccuagucagcuauaagaucacaaggguaaacagccuuacucuacaguguacuguguugccagaugacuuuuuuuuuugcccaacuauaggcuuauguaaguguucugagcacauauaaguuaggccaggcuaagcuaugauguuugauagauguguuaaaugcauuuugacuuaggauauuuuccacuuagaauggguuuauugugggacauaacuacuuuaagucaaggcacaucuguauaauaaaaauauaacaaaaggcauuggccaugauaagguuaacuaguuugugaaauuaguuucaauuuuuaauacaugcauauacauuuguauacguaguacauacauguauguaaauguguuuucagacaugguguaaaauguauuucuuacuauaggaaaugguguaaaaguuugaaaaucacugugcuuaagucaaacugaacuuggauguuuuaugagaggcccucugauuauauuaaaugcacauacagguaauaguaauacacuguuagugucuucucgaaucaagauaacaguaguaaaucaugcuauccauauuauagggagcuuucaguaaauauuaauggacaugauaguuuuugguauaaguacuuuaugcuuauuagauuauggugggcuauucuggagaauaaacuuuaaacaguuggaauauuuagugcuuguaaagauucaguacuucagaccauucauuauguuggcauuuucaaauaauuugauaguaaaauuuaccucaaacuuauuuuagauuauaagccugcuuugcuaaguugaugacucacuauaugaauucauuuuuguggugguauaaacacuaaauauuuuauguuugauuuaaagauuuucuaacugcuuaacauuuguggcuuaauuguuaauuagaaaaguuauaauuaagauuuuaaaauucuguuuagaaauuauuucuuaacauaaauuuaggugugggauggugauacuaccagacaaguucagagaauaucaugcuuccagucuacuguaaagguaaaaucuuaaguaaauaugaguuuuuaugacaaucuauuuuugucucagaagacaugguuuaaagaguuagacgaaauuacuuuugugggucuuaugaauuauuucuuuccacacacuuguagucauuugcuucguguaagaucagauuuuugagagcacauguauuaaguguuagaauguuucaauuugaaauuagagcaagggauaaucccaauagcaagauaaggaaaaaagguaguaccugguauguuuuuuguagguaguuccaggaagagauauuacuuguagaaugaccauaauaguagcuggucuguuuucuuuauacuuugaauuuaaaauauagagcuauuugucccaugaccuuugccuucucuaaggucacaaaggcaagacaugucaguuacuuaguuucaaaacuaaaaaucuuaccuggcuaauuugcuguuacuguuagguuuauuccuuuuacaaacaauuauuaauuggggcuaaugauaugacagaagcucugcuacguuuuagagaaacaaacauagauaagacuugguugcuugugauuccuacagaaauuaaguguucagagaaagugccacuguuuuuuaguaauguaagcaaguuuuggaaaagauaguaguagcaguagauguucccucauuuacuuuaaggauaacugaucuccauauuggagcucuuuucuuuuuuuucuuaauguaaaaagaauugcugugugccaauagguagaauaguugaucuuuucccaaaaaggcagaaucucugguagccaucucauggcacugugcuguucaaaauaucaacuuagucaaguuucaggggaagaaagugccauguacuauauauacuucuaucuaacuuaacaguggauuuuuuaagaaggcauuaaaaaguauugauuugauuaaaaucucuauacuuuaugugaccugaaaugaugugccuuuuacauuccuuuaaaaauauucuugcuaccugaaaaacuaaggucguuaaguuuccaaugaaaauauguggcuugaaggaacaaagagaaaaaaauuuaauguauuugggggaaauuccuuuugguaaacuguguuaugaacugguuauaggaacuggucacuaaaaaaguaucuuauuccaauauagugaaaguaguuuuaaaagggguuuuacuguaaugugaaucagcuagauauuugugucuguuuucuccugcugugauccuguuucacauaaaaauuguuaaaaaauagcauugcacucauuuaguucagugguucaguuguucuugaauagauaguuuauccaagaaauuuauaucccuaauaugagaaauacuaucauuuauuuuuugaacuaacaaaauuuuuuauaaggguugauguuagcaaggagauagugaaauuggcauuuuauugcauauugagacuauaaauugauaugaucuucccggaagguaguuuggcauuaugaaugaaucuaaauaaauuauuauaugcauuaauccagugaucauucuagaaaacucuuuaaaggaaaugaucagaaaauagggcagaaauuuaugaacagaaauguguacuacaaauacauuuuuauaaauggaugauuggaagugcccuaaaugucuuauaagaaaauacauuaugguagauauauauacuaaaauuuauauuucagaagaauauuaaaagaggaaaaugcuagugguaaaauguuaaguaacaaaaacauauauuauccucaacaaaauauuaucaaaccaaauucagcaacaucuaaaaagaauuauacaccaugacuaagugagauuuaucccuggaauaagcuuaguuuaacaucugaaaauucaucagugaaauacaccauaguaagaauaaaggacaaaaaccacaggaucaucucaacagaaacagagaaggcauuugacaaacuccaacacccuuucaugauaaaaauacucaacaaacuaggaauagaugagaauuuccucaaccuaauaaagggcuucugugaaaaucucaaggcuaauuucguauuaauggugaaaggcuaggcugggugugguaguucaugccugcaaucccagcgcuuugggagaccaagguggguggauugcuugagcucaggaguucaagaccagccugagcaacauggugaaacuucucuacaaaaaaaaagaaagaagaauuagccaggucugguggcacaugucuguaaucccaguuauuugggaggcugagguggaaggaucacuugaguccaggaguucgaggcugcagugaguuguaauugugccacugcacucuagccugggcgauagagcaagacccugucucaaaaaaaauaauaaaauaaaaauuuuuaaaaauggugaaagacaaauaauuucccccaaagaucaggcacaagauaaggaugucugcugucagcacaucuguuuaacauuguacuggagguucuagccagggcaguuggacaauaaaaaagauaaaugacauccauauuggaaaggaagacauaaaacugucucuauucccaaauaacaugaucuuguguauauagaaaauccuaaguccacaaccaaacuauugaggcuaguaaauggauuuagcaagguuucaggauauaauaucaacacacagaaaucaauuguauuucuauucacuagcaaugaacauuccaaaaauuaagaaacaauuccauuuacaguugcauccaaaagaauaaaauacucagaaauagauuuagucugggcgggguggcuuaugccuauaauccuagcacuuugggaggccaaggugggaggauugcuugaggucaggaguucacgacuaaccuggccaacauagcaauaccccaucacuauuaaaagaaauuugaaguaguaugagacuuauauaccaaaaacuacaaaacauuguugaaagauauuaaagaucuauauaaauggaaagacauccugagugcauggaucagauuuacuauuguuaugauuccaccacuacccacauugaucuacagauugaacccaaucuuuaucaaaauuguagcuggcuuguuuuuuuguuguuuuuuuuuugagaaauuuacaagcugauccuaaaauucauaugggagugcaagggacccagaauagccgaaacaaucuuaaaauggaaaaacaaaguuccaagacacacuucccaauuucaaaacuuaauaugaagcuacaguagucaagacagugugauauuggcauaaugacagacaugcagaucaauggaaccgaauuaaaggcccagaaguaaagucucacauagccaacugauuuuuugacaagagcgccaagaaccuuuaaugggagaaagaauagucucuucaaaaaaugaugcugugucaauuggacauccacauacaaaauaaugaaauuuuaucccuaccacauaucauauccaaaaguuaacucaaaaugggucaaagacccaaauguaagagcugaaacuacaaaaaucuuggaagaaauauaggcguacaucucugugaccuugggcuaggugucuuaaauaugauaucaaaagcauaucaacaaacaacaaaaaaagauaaauuggaccucaucagaaugaaaaguuuuugugcuucaaagugaaaagacaacauacagaauuggagaaaauauuuucaaauuguauaucugauaagggacuugugucuacaauauaugaagaauucaauaaaaaagcaaauacuccaauuaaaaauagacaagauuugaaagaaagaaauuucuccaaagaagauaaacaaauagcaaauaagcacaugaaaaagagguucaacaucauuagucauuagagaaaugcaagucaaaaccacagugaaauacuauuuccuacauacuagaguggcuaauaucuaaaagacaaguguugguaagaauguggagcaauuguaaccuucauacauugcuggugggaucuagaaugauacaauacagccaccuuggaaaacaguuuaaacagaauuaucauuugacccagcagucuuacuccuugguauauccccaagagauaugaaaauguaaguucauauaaaaauguguacaugauuguucauagcaacauuauuaauaauagucaaaaauggaaacaaucuauauguccaucagcugaugaauaaacacaauguauauccacacaguggaauacuauuuggcaauaaaaagaaaugaaacacuggcauuaaaaauucagagauuagacaggguaggaccacuagaaauauaaacugcauugguuauuuucaacucuuuuuaauccaacaguuuuaaaagcagccuaggcaagauuaccagaaccucugccuuuuauuuucuguucuucucucucgcucuugcccuugucugacucagagucagugggcgaggagaguacuauuaaagguaaagggcuuauaugguacuugaaacacucacuuuccugacuaccaaauguauagaauugagaagacuugggcauuauuuauucuaaagauacagagaaacuaaggucauaguuucaauuugauuuaaaaagggguuuaagcaauuguguauuaguaauuuauuacugaguaacaaauuaccucaaaacuuaguggcuuaaaacaauaaacauuugucaucucacaguguuugugauuaggacuagagagcaucuuaucugggugguucuggcucagggccucuccugaggcuccugcuaucugaaggccugacugcgguggaggagcugccucccaggaggcucaccuacgugcuuggcaaguuagugcuguuuguugcccagaagccucagcucuuugcuacauggaccuuucuccaugugacugcuuuagugucuucaccuuagagcacgugauccaagagagaacaaggaggaggccacaguaucuuuuaugacuuagucuuguaagucacacaccauuccucuugccagaaucuguuugguagaagcuagucacuuaguagugcccacaugaucuacuaaggagaaauaagcuccaccuagugaaggaagggguuaaagaacuuguggauauauuuuuaaaccacugaacaaugacugcuuaaguuucuaaccugauauacauuucaaauaaauuuugcaguguuuaacuguucuucagagacuagauguuuggcuuucuggugggaaugaccuguguguguggaaccgaaaauuagaucuccuguguaagacuagccaccuuucugauacagguaaaaaacaucaagguaauuuugaacuaugauugacagacuagaagacacagcagaucuucagagagacuuuccauaaguagaaaggucaauauaggggauuuuucuuuuucaguucugaagauaacagguagccauauucaauucagaucgggguuguguaaaauauauuuuuauccugaaucaggaggagaagacuccacucaggaacaaccuuuuccaaugcucuugggcuguuuuccugaacuguguuuggugagcacgcugauaccuagaagcagacccuuacgacuuuacaguagcauuuguggggucauuaacuuugaauaaaugccuaaggaugaccucuuuuuacaauuguccuuaccaaaaagaucauacaugugcaagcuuacugauaaaguuucauuuucucacaauucuguguacauacgauuuugguuucaacagaaaaaaaauaaucaaaucaguuuugacuuuuugauaccaaggaucuuaaaaaauaaaaucuauuuuuagaguaaaauauuuaaaugaguagauuuuaauaacaaccuugaagucacacuaacuauuguuauuucuaaaaauaaucaaaugagccuggguauccuagaaggaacauuguugugcauguuguugauauuucagugguagcaggagcccugugaauugaauuuaguuacuaauaggagcuagcuuagcuccacguagauauuuuaaaguaucagaaacauaaugacuuaggaaaacuaaauccauacauugcuaggguuuacaauuuaaccacucaguucaacauuugauuacuaauagucuugcucaaaucuagaauauauuucccuguuuacuauuaucaugaauuaugugucuuuauguucauuuuucucucucuuucacuagccugugguuuucaugaauuuuauuuugguaaaguuauauuguaaaauguugaaauuggggcugaaaagaaucuucuguguguuccuggaaauagccaccucuuauugcagucucccuuuguuuugcaaguuauguuuaaguacuauauauuaaaucauuacaauacugccauuuaucagugucucaagaguuaacagaaggcuuugaggguaucuaugggaaagccuugagaaggccauggguuacuauuggugagcuguucaucauuuggguuuuccaaauuacuggaggccagauuguuaauaguguuauuagauccuuaugucaugauguccuuucauaagcccugcuugauuuauggacugguggagcuuuuacaagcaguuauucuguguuuggaaauaagcaaagacaaucuuagucaaugugauacaauggaaggagcccuggacuaaaacacagggcauccguguccuuuccaguaauauguuuugugauucugaguauuagguugcuacaucuggauuguugggcuucuaguauuuucacauauaauuuagugaaagauuuuuaaacaagcuguuuucugcauuuagaauucuucucuugcuauccacccugcuguucucccauguccucugccuucucuguaccauuccuuugccuuccuugcagcaccauuuccuccuucuuguacaugggaaaauacaaaaccuacuguuaaaauaugccuauguggagaaaaaucuuggccagaaauacuauccaaaucacaacagucaguccuuugauggaugggaaggauaagcaaaugacuagaccguuuucuacacuugcauauauauuauaaauuacauauauaucauaauggaaaaauuaaacagguuuuuuuuuuugccaacacguggugguucuaauuuaucaacucuuuuauucauacugacagaagcaaaauuguaacaugccuuguagaaguuauaguuacgcuaaaaucauuaaccucuuuacuuaaauaagugaaguguguuagaauguugaaucugauucuuucauuaauagaagaaaaauuuuacauguauuaguggaucacaaacaugcuauuugaaggcugcuuucuuagcugcugacuguuggcuaguucauucaaugccagggagccugcucaggcuucuaaaguuuacaugaaggaaaaccccaauuuuacaucacuuuugagcuagccaucuuguaaaugggugauggugauuaucuuaagggaucccugguaaauaagugugaauugcugaaucuaccacuuuaucacaauaguaaaaaaaaguacaaaaaaacccaaccccauauucugcucuuaauaaaucaauaaugucuuccaaaagucucagaaaccuacauuuaacaaucauuuuccauuaguaagcaagcaaggaaguguguguggagcuaguucugugugcuuuaucuucuuuauggaaaacgacugacauaaaacugagaauguuuuuguuuuugauauaaucugugagaaaaauaauuugaacuuuguuuuauauguuuuuggagguauuagugcuuugguugaaauaccuaagaacuguguuguggcagcaguuggcaaagaacugagugaguaugaauuuuuuucuuuuuguguauuuugaacgagaauuguauacacaugcuggaaggacuaaaguaauuuuuuauuuaagggacauugcgugugccccacucuuggcuucuugggauuguugaagugauacagagacuaagacauuuucaggauguuaggccagguuucuuuuucuuaucaguguuuuaaucaguauguuagcuugguuaaacaguuuauugcuuguuauuccaaaauuccagucucaagaucacuucauaauauuccaacuaaaguagaauuucccauaaguucaauguguaucagaaagaguucucuuuucuauugacugaaaaaccuucuuuugacaaccacaguuugaauaugaguagcugucaggauuaaauaaccuggauagagauuuguaguuugguaaaauauugucagagacacagaaagaagcauggcaugaccuaucuucuagagagaaaugugagaaagaaaagauacuuucguaauuugaaaaggacaugaucucagagacuugucacuucucagauguuagugaugcuaaucuuugagcauccacagcaccugguccagugguguauuuuuaaaacacucaguacauugacgguaagccuguuuauaaacaagucucucucccacucuagacugagcauuugugacugggccuuauucacauuugguacguagaguuccuggaacauaaauguuuaguaaaugaugauagaaucacgucuguggauuuuauuauggguuuucuguauugauuaaaguuaggauuuauacuaguuuaaauaaaacuguauuuguuaaagucagauaaugaguaaagcaacacauugaacauuacuauagucagaagaacuguaugauauauaaacauuauaagacauacucagagaauuuauaauuuaaugguauaugccuaggaaucagaagcuuuuuaaaaaagaaguugcuuaugucuucacugaguugaaguuaaacuuggauuugcagcuuauucugucgcaaugcuuacaugaguaagagacaugaguagagaaagcugauguuggaggugauugagggaugugggcuagucacugauuagggagggagugaguugagauaacaagacauccguugaaacccuagagagaaugggagcuucacuguuuggaaaagucaguaaaggaagagaguucuucaggacacauucaguauggguuuuaguagaucaucucaaacaucucaagcauuugaaagaaauaguuuaaaguaguaugaauaaggcuuuuuuuuggagauggguuuuucaguaugguagguauuuuucacuuaaugaaaugcuuguuuuuagagcaggaguaguauuuuauccucuuagagcauuguaauaaaauuuuaucugucuuuuucauuuaguaauuuucagguugguagcacccacagaaggaucacuagaaugggauauucuugaaguuaagcgccuccuugaucaccaggauaauauucucucauugauuaaugucaaugguaagcucauuguguacauuuauuauguacaguuuugugcuuguuaacacaaccugcucugaacacgagccuugcuuaguucugggauucuagaauaagucacuaaaauaaugggauugucauucucuuuuacucugaaguuuuagccgguggagcugagcaaguuuccuagauugcuaggucuaagauuuagggacaaggaaaauaguguaaggcagagaaaauagaggagaacauaaugaucucaggcacugcuugguagcugugggaugacugucacaggcuguuucagcauuuuuggcagcuguuucuggcuaguuccucuuuuguagagagauuggaaauaugcccuuuugucuugcuguccacaccauacaauaucacauagcaaguuacacacuuacacuagaaugagcaggauucaagccaguuguaauccugguugaagacucucaaagaauaauaccaaacuaaaguaaaagucugcagaaaaugggucaugucuucccuuccuuccucgugguggggguuuugaccugcuguacauccuauuuggcuuccuaaaugauuuuaaugaguaucuccugugagcuaaaucugacaucagauggcaagaucacaaaccacugaucuugacauucaguucacuugcagauaagugacagcuuauaucaucagaacugugcugggugaucuguguaugaagucacaugagagggcuuuugguggcuucaguuugauagucugguggagccugcaggacgauccuguaaggcugcuugggaguaugauguagugggagggcuagacagcaccccagcaacauaucucccugaggccuggcuuggcuuuguuuuuuuuguuuguguuuguuuguuuguuuguuuguuuugagauggagucucccuguguugcccaggcuggaguucaguggcauggucucgacucacugcaaccucugccccccggguucaagcgauucuucugccucagccucccaaauagcuggaacuacaggcgcauaucaccaugcccagcuaauuuuuguauuuuuaguagagacgggguuucuccauauuggccaggcuggucucgaacuccugaccucaugauccaccugccucagccucccacagugcugagauuacaggcaugagccaccaagcccggccggcuuuguuuuuaagcaguauuuugcgugaaugugagacaaaggggagcgagggacacagagaguaccaagucuagucuccauuuguguccauucagucacauguucagauacaccaguaagagugucccucccagcuccaaaaucuuccucccaaauagccaucuuauuguaaaacucagcugcaggucuuucuaaggacuagauugucuguguugauagaaauaacaaugguugcuggugucccuuuaauuuucucugggggcucuuuuucucuagccauggauggagacagcacagaaggcaaguucuuauuugggaagcccucugaagccucauuggugacacugagucuuaagucucaaguucccagggcugcugagaaaagcccagcaguauucggcccauuacaccggucaugcuuaguuauuuuguuuuagcagugaagcacuggcaccacugagccagcaugguuacuuaaaugaagaugauaggaugauacaagauagccugaacuucauggcaugucuuuuaccaugugauaugcagaggaacuuacagcaguuucugaaagcuuucuucgaguauucauuugccaaauucguaaggggaaaaaagggaaaacuaaagaaaaaaguuguuuaugaaaguuacagaaagccucaugcacuuuuuacuguuuuuuacuaucuuuuuaaaaaauuucuucuaaaaaaaugggauacaugugcagaaugugcagguuuguuacauagguauacgugugccaugaugguuugcugcaccuaucaaccuguccucucaguuuccuccccuuccccacaacaggugcugguguguguuguuccccucucuguguccauauguucucauuguucaguuuccaguuagagugagaauaugcggcauuugauuuucuguuccuguguuaguuugcugagaaugauggcuuccagcuucaugacuaugucccugcaaaggacaugaucucauuccuuuuuauggcugcauaguauuccaugguguauaugugccacauuuucuuuauccaaucuaucguugaugggcauuuggauugguuccauaucuuuguucuuguaaauagugauguaguaaacauacaugugcaugugucuuuguaguagaaugauugauauccuuuggguguauucccaaaguaaugggauugcugggucaaaugguauuucugguucuagauccuugaggaaucgccauacugucuuccacaaugguugaacuaauuuacacucccaccaacaguguaaaaauguucuucccauucuccacagccuugucagcaucuaugguuuccugacuuuuuaauaauugccauucugacuggugugagaugguaucucauugugauucugauuugcauuucucuaaugaucagugauguugagcuuuuuuucauauguuuuuuggccacauaaaugucuugagaagugccuguucauauuuugcccacuuuuugaugggguuguuuuuuucuuguaaauuuaaguuccuuguaaauucuggauauuagaccgaccuuugucagauggguagauugcaaaaauuuucucccauuuuguagguugccuuuucacucugaugguaguuucuuuugcugugcagaagcucuuuaguuucauuaguucccauuugucagcuuuggcuuuuguugcaguugcuuuuggcaucuuugucaugaagucuuugcccaugccuguguucugaaugguauugccuagguuuucuucuaggguuuuuaugguuuuaggucuuauuaagucuuuaauucaucuugaguuaauuuuuguauaagguguaaggaagggguccagugucuguuuucugcauauggcuagccaguuuucuuagcaccauuuacugaauaggagauccuuuccccauugcuuguuuuugucagguuuguugaagaucagauggcuguagaugugugguguuauuucugaggugucuauucugcuccauuggucuauaugucuguuuugguaccaauuccauguuguuuugguuacuguagccuuguaauauaguuugcagucagguaaugugaugucuccagcuuuguucuuuuugcuuaggauugucuuggcuauacggggucuucuuugauucuauaugaaauuuaaaauaguuuuuuuucuaauucuuugaaggaugucaauaguaguuugaugggaauagcauugaaucuguaaauuacuuuaggcaauauggccauuuucaugauauugauucuuccuaucuaugaggaugaaauguuuuuccauuuauauguguccucccauuuccuugagcagugguuuguaguucucuuugaagagguccuucacaucccuuguuagcuguauuccuagguacuuuauucucuuuguagcgauugugaaugggaguucauucaugauuuugcucucugcuugucuauuguugguguaaaggaauucuugugauuuuuguacauugacuuuguauccugagacuuuauugaaguugcuuaucaguuuaaggaguuuuuugggcugagaugaugggguuuucuaaauauacaaucaugucaucugcaaacagagacaauuugacuuccucucuuccuauuugaauacccuuuauuucuuucucuuuccugauugcccuggacagaacuuccaacacuauguugaauaggaguggugagagagggcauccuuguucuguaccagguuucaaagggaaugcuuccagcuuuugcccauucauaugauauuggcuguggguuucuuauaaauagcucuuauuauuuugagauauguucuaucaauaccuaguuuauugagaauuuuuaauaugaaaggauguuaaauuuuaucgaaggccuuuucugcaucuauuaagauaaucaugugguuuuugucauugguucuguuugugugauggauuacguuuauugauuugcauauguugaaucagccuugcaucccagggaugaagcccacuugaucaugguggauaagcuuuuugaugugcugcuggauuugguuugccaguauuuuauugaggauuuucgcaucgauguucauaagggauauuggccugaaguuuucuuuuuuuuguugugucucuuccugguuuuggugucaggaugaugcuggcuucauaaaaugaauuaggaagucccucuuucaguuguucggaauaguuucacaaggaaugguaccagcuccucuuuguaccucugguagaauucagcugugaauccaucugguccugggcuuuuuuugguugguaggcuauuaauuacugccucaauuucagaacuuguuauuggucuauucagggauucgacuucuuacugguuuagucuugggaggguguauguguccaggaauuuauucauuucuucuagauuuucuaguuuguguagagguguuuauaguauuaucugaugguaguuuguauuucugugggaucaguggugcuguccccuuuaucaucuuuuauugugucuauuugauucuucucucuuuucgucuuuauaagucuagcuaguggucuauuuuaauuuuuucaaaaaaccagcuucuggauucauugauuuuuuuggagaguuuuucuugucucugucuccuucaauucuucucugaucuuaguuauuucuugucuucuucuagcuuuuggauuaguacuuuuuacuuuauaaacucuaugacuauaaaauuauacuacagauaauaaauaagccaaaggcguauuuaggaaucaaacaugaccaaguagucuguuaaaauuugaaaaugaucugcugacagucucaucuugcaguacauaggcacguuagccaugauguggaugucagugauccugaaauguuuauguuguacaguucccugcuucacuugcaggagcucugcuccuuucuccucacccauuaccaaugaaagauauggccaguugcuugggauuguacaucacagggcaaaucuguuuucagagggguggccccagggcaaccuuagaauuguaugagagaauaccaacaaguguggauaaugaauaccagauuugcuaaaaagauuggaaugcccaggcagaagguuuucuaagacagacaaaaaauaacugauaaucucuccaggcagaaggcucugggugcuccuuuauuuuauuccuuuucuuguauuauguugccagcaucuuuugguaaucaugaaguacuaguacuugugagggauggauagacagauaccaggugagauuuucauacuaaguggcuuuugacacaggaugaaaauccauccacuaauaauauauaauugagguuguuugucaugaaacauuuugaaugaccuguuugggaauuaguuugccauguguaaacugcuuaaaaauaugugcugauuggccaggugcagugacucacgccuguaaucccagcacuuugggagcuugagguggguggaucaccugaggucaggaguuugagaccagccuggccaacauggcgaaacccgucacuacuaaaaauacaaaaauuagccagguguggugucacaugccuguagucccagcuacacaggaggcugagacaggaauugcuugaacuugggagguggagguuacagggagccaagauuguguuacuguacuccagccugggugacagagugagacuucauuucaaaaaaaaaaaaaaaaaaaaaaaagugcugauugagcugaaugccguauuuuauuuuuagggaaaauuccaacuggucauuaauauuuuguuucuacugcauggagguaucacagacacuuggaggauuaagucagagcaagcagcugcauggucucaguagguuaauucuguguugugacuacagaugcagagugagagucaaggggaaucuucacuccuuagcuucucugguucuuuuguaguuugaaugaaauaggaaaaaggagggaaaggugugggaaagaagguccugggaagaugaguacugccuuaacuuucccacuacuaaaacuagaagcccguuuugcuccacagaugagaagugauuucuccacagagcaaguucuauagagucuguuaauaaacuauagaaauuagauauuaauaaucuaccuauuauggccuuggagucaagacaaauaauauuuacauguaggauugcugguaauucuguaucucuuaagagauuguucauguggucauuagagauuucugucgugcugguuuauuugauaaaugaaauaauuaaaucauaauuacucaucuguauauuccuaaauuaacaaguaacaggauguuuuaauacgauuaauguggaauaauaccaggggcucaaaauacuaccaggggcgcaaagauaauauuugaugucuuuuuaaaauggcuacacguuuauuauucaauuugauuuuuagucacucauuuaaugcaugaagaauccaagauaaagguuaaacuacuuccuaaagaccaccugucuagcaacaggcagagccaaaaucagaacuuggguuucuagacuaagugcauuauagucuucugucuuacccuaaauauguaauaauuuaaauaaauuacauuuauuugaaauaagacuagcaguuguacauuuucuauuaaauauauaguguguaaaauaaauaauauguaaaauggaaaaaaauccuuuuuuuuuuuuuuuuuuuggggagacagagucucgcucugucgcccaggcuggagggcaguggcgcgaucucggcuuacugcaagcuccgccucccggguucacgucauucuccugccucagccucccgaguagcugggacuacaggcgcccaccaccacgcccaccuaauuuuuuguauuuuuaguggagacaggguuucaccguuuuagccaggauggucucgaucuccagaccucgugauccaccugccucggccucccaaagugcugggauuacaggugugagccaccgcacccggcuuuuuuuaaagguuuuaaaaacuuguaaaaguuauacauagucauaguagaaaaauaugaaaauagugaaaaacauuaaaaauauaaaaguuaauauuaaaaucuuuccacuauccaguauuaaacaccaguccacaucuuucuaggugauuuucugggccuauguauguguguacauguguauuaauaugguuuacuguuuuguaacaauaugucauaaauauauuuccauaucuaaguuuauauuguuaagcauacuuuuauaacuuaauuuuuaauaacagcauuacuauuucauuuuguugaugucuuauucaauucucaauucgauguguaguuaucuucagauuuuuaagauuguguauuuguacauauauguauguaacaaccuuguacauuuauguauuuccuucaggauaaauuccuagaaguggaauuguuggaucgagauuuacauuuuucaagguuuugauacauauuagcaaauuaaucuuugaaaaaaauacuaauguauaguagggcauuaggcaauacaggaaugugcugauuucuuaugcuuuugccaguacuguguuggguauuuuccuguuuuauauuuccugauucacaagucaauaaaugguaucuccuuguuuuuagauuucuuugauuauuaaaggaguugaacaucuuuucacguuuacugaccauuuguauuuguuuugccuuuucagguccuuuucccauuuuuuuuucugcuguauuuaucuuguucuuaauaauuuccaagaacuccuuauguaucaaguauaauaaaccuguuuugucauccaaguugcaaauuuuucccagcuuuuugucauuucaguguauuuguguguguguguguguguuuuagacugagucucgcucuauugcccaggcuggagugcaguggcgcgaucucagcucacugcgaccucugcgucccagguucaagcaguucuccugucucaaccucccaaguagcugggacuaaggugcacaccaccaugcccggcuaauuuuuguauuuuuaguagagaugggguuucaccauauuggucaggcuggucucgaacuccugaccucaggugauccaccugccucggcuucccaaagugcugggauuaccucgcccgguccuuguuuuuguuuugccaagcagcuacuuacuaggaucucuuccccuggcaccccacucugcuuccguuagagcccuuuaccacuccacauuccuaaaaguauucaccuuuaucuucuuccauccuuuaacuaacuuucauguuuuaaucuauuugaaacuuauuuugguguaugguacaagauaagguucuuuuacuuuuauuccccuuaaauguaaccagauauuccagcaugagguauuucuuuacugaaaugaaaugcaaucauuauuacauacuaaauuacuaagauaauuugagucuauuucuggccuucuuauucuguuacauuaaucuuucuguuggcuugccuagguaccucacuguucuaauuacugugguuuuauacggcauuacuacuagacauuccauucaguuauaucuuuacauagauaaaaugaucgauaaugaggcauaugugaacuuugccuagauuugaguuuugucaccggcucccacgucggagagcugaucaucugggaugcccuggacuggaccaugcaggccuaugaacgcaacuucugggacccaucuccacaacuggacacccaacaagaaauaaaacucugucaaaaaucaaaugacauuucuauucaucauuucacaugugaugaagagguaaaaaauguauacacuaucuauaaacuugccuuugacauauauaacccaauuucugauuuuaaaaauuuaaucccauguuggacauaaaaaagguaucauucaugguuucagguugugcuuuaaaauggucuuuuucuaaaauuggaugauuuguguuaagcauuuuaaucuuugcuucuaaucucgaggcaaggaaaugauuaaauggccacagauuuaaaaauuauugaaauuuuggguuggauuaaauaaucccauuggauuugagguuaaugcuuaaaauuguuuuaagaaacacugugaaaaagaguucuuuugaagaucugacacauuuccuagugaggcaaagaaaauuaaaaauuuuaggaguguuucucagucugcuggcaucuuggggcaagauaaauugagugagaauuguuggauuccaucuuauaggacuugggagugaugcucuugaagcacuuuagaucuguuuugcugugagagauuaguaccaauggacuacugaaucuuaucucugaucugaaaaaacaaaucucuuagcaucaggggcucagaaaauguuuuuaaagggcaauuaacuuuucuaaauguaaucacaagaaauguuuaugaauuguacccuucgaggagaaggaguuggggaggcuuuucucuauuuugugacuuucuauacuguuuaauuuuucuaacggcaugcacguuauuuuuauuaaaaauuucaguaguaguguuauguaguggggggagaauaugauccauuuuucuuuguaccacucuuuaaaaacaaaacaaaagauuaggauaggaacaggacuuagaaacacuaauauauucaaagauuguuucuuuguaucccaacuuuauuuugaaaaaaguuaaauauacaugauaaagacaguaugguuucagaaaagauagagacuagaucacuaagaguuguagcccuacaaauuaucuauuuuaaauguuacauguuuuuucucacuuuugugaaaauuaauauuuaaaaguuuuguauuuuaaucuuaaauuuuuuaauugauguuuauuuucuacuauauaugcuugauaaagcauuguauaguuuucccuaauuuuucuucuuuuguugugaguucuuuccuucuauaagggaccguuaguuauugauagcggggauagcauccccauugaguaaaugcugccuccaaagcucaugaauucucuaguuguguuuauaauuuucuuccugaccuuggauaaauuacuuaaacugugcccagauuuccuggucuauagaaugaguuucgggggauuuuggcauugaauacaauccacagggcuuuccauuuuaguacauuggcuagcaguguucauuaaugcccuggcauugggccucggcugcauugcugauugcagaguacuaauccugagagucaaggggaucauucaagauuuaagauuccagcaagccuugggggcaugcuuugguucaguuacuauaggucugaguugaguuuguagucuuggaggcugugugagaaagguuggagagcccagaaucucuggugaaaacaagaaggcaauauguagggauauuugaaaggucugccucauggggauaucuauugaguaagaauggaugauucuaggacaggugcuugcaaaaauuucaaaggcuacuacugcaugugagucacgugaggaaugagcaagggacuggaguaacaugaccuugauucuaauauugacuccauguuucauuucuugugugacuuuaaucucuuuaauuuuaaauuccuuaucuggaaaauggcaaugaugcuugccuuucuuaacacgauguugugaggcugaagugagauaaguauuagugaaaaugcuuucaaaagauuaaaguuguuuuaguaaaaagguauuuauuucuaauaguacauuuggaaaaauguuuuuugaaaccuucagaggauugcaugaugauaaugccacuguagccgugcuuuuuuguaucacuuguaggucuccugauugcuuaagauguggaaugcaaguaauuuugcuugcauuuuucaggcagaagaagcuagguaauuuucccaaggauauaguguuauuuaaaugaaaacucagguuaucccucaacagcuuccacugcagggccaggcugcuagcuauagcuuuucucuagauauauuucagugaggaagaaguggcgcuaagggauauacuaugcagaccuaccuuucucugcauuagugguuguguccuaccuucuaaaugcucagagcuuucuuuagugcuuugacauuuugggguuucagagauuaguacuguaauuugggcuaaaggcuaggaaugggaaagguaaugguggcuuucugaugucacaugagggcuggaaauccauuacacuaggaagggugagugcuaguuuuaugcccauuucugaacuucuuccccuagaauguauuugcugcaguuggaagggguuuauacguguauagccuucaaaugaagcgugugauugccugccagaaaacugcacaugacuccaauguccugcacguugccagacuuccaaacagguacaaguucccaucuguucugcaauagaugaaagcaagucacaguucccagggcuaccaguguaauuucucaaguggccaaguuaccuggcuucauggcuugaccugcuguguucuuuuggaaauggagaaugccugagggcugucucuaacagaaggguauguggcaguauauuacagaauuuacaagaagcaaggugcaaaugaauuacauugaauuucauuguuaagaagagaugauuuaaaauuugguauuuaacaacauaaacgacuuuggggccacuuacauuguaccaauuuuuauauuucucauaaaccuaccuucuuuuuguuuauggccagaaucaaaugguugcuggucuccuuguugugugaggcuacuaagugagugguuuccugucaggguagauuugcugcugagcuucuagggacgaacauauggacagggacuaucauuauuuucuaugcaggauauuuuuauagugaagcacccagagaagagagguagcaagaggagggaagggggcugcuuaggacauugugaaguauaauucacacuguuuucccaagggcauuuuuuuaaauggagagaaucaauuuauagcauuugagcuaauguaacgaguaacauguggcuuuccuaaagggugcuuuuaguuugcguuguaacgucaugcuaaauugugauuuuugucaguuccugcuaagagcugaauaaaagcaguugagggcuccacugauuucuuucacugcaaauuuagcauuggcccucaguggugcgcucuuuuuguauuacugauuuucuguucugacaggcaguuaaucucaugcucagaagauggcaguguacgcauuugggaguuaagagaaaaacagcagcuugcagcugagccuguaccaacaggugugugucuucucucaaaaagguagucuuuuucucuccuuuuuucucacgugaaaggcaggagaaggacaauuaugugaaaccacuaaaauaauauagaaaugcuccaaauaggcaucagauguuuauagaaagcauaugguaauugagaucuaggauuuacagcuuaauacugcccuaauguagaacugccacuucauuucaaguaagauagagauuuucuuguuuugagggaaaacuuacuuucugguaaucugaaugaccaaauggccuaaugaaguauucauuuauauugucuauaauucugacugauacacaaaauuuguaccgucagaugucaaaccaaaguguucuuuacccuugauguugaacuuaauuuaugggaaaacauacuuuuccuugugugcuuauaucauaauuuuaugagcucuugacuuccagguguuuaguuugaaaaacaaaacucugaaggguugaauaaauuaguuaccaaccuuugcacaagaaaucagaugcugguaccuaguuguuucugguccuuuugacuuccugaaguccugggguguugcuuuugcacauacauauacagcuuuuccccuaugccuuguuuguugaucugaguuuugcccuuuuuucccuugacaguuagacacugccauucaagcuuuguuucuguccuguuuuauuccaagugucuuuuuguuaauauaccugcaccagugggugacuaggggcaauaaaaagagaugaagaacagaccugguuagcuaagaaagaugaaauaacauauucacaaaacccuagcacggugcucagguacuguccacuuagcccuugacuaaaauaagucuggaaccucuucacauuuaaauuuuguuuuucugaucucauguuauuguaaguacagagcacaguaauuuuggaaaugauucuuuuucuagguuuuuuuaacauguggggauuuggaagagucagcaaacaagccagccaaccuguuaaaaagcagcaagaaaaugcuacuucauguucacuggagcuuauuggagauuugauuggacacucaucaucuguggagguauugcuguuuagccacagaauguccaagcaacuccugcuuuugcauuucauugcucuuuucuuucaguugaucucauaaaggcauauacuuuuucuuauaucuguagguguuugucagaucugaacauggaaugggauaggcuauaguaugugcaguuagggucucccuuuccggauauaugauuugaggaaacaaggaaugcauugcuuuuaagaauggucuuaaucaccauuauuuaggagcuggagauagcugacaguaagggcagugugaauaauguugacuauaugacaacaguaaacagaggaugcaugaaggguugugguuauauguguauacaguuaaagccuuaacagaaucgaauuccaggggccuuuaucaaauucaugaacagaguccuguuucuccugccuuugaaggauaauaguuuguuagcuuuaaugaaaccuaugccuugauuuucauugugcaaauaugaaaguuuuaguugaaaauuaugaaaugcguaagcuuuuaacauguagaaauccagauacauuaauauuugcugcaggcaucauugccuguagugaaggaauaagaucaguugagguaacagauuagcugugagaacuaauaacaguguaaucagggcccuaaggaauuucuuaaauuguucuucccuguuucauagccaaagaacaaaaaauuucuuuucauuugaaagggcauucaugcuuaggaggagcagcggcagcauccuuguuagugagcauuuccuguauuucaggcacugugcuaaacacuggcugcuggaguuuacagagagagaugaaaacaguccuugcccucauggaucuuacccuugaguggagagaagggguauagaccuaauaggcuguuacccuaggcugcauuugauggacccaaguaagcagcagugacucagaagaaacauuucuugcugaaucuuguaaaugguuagaggauauaggacuugacacuugagcugaaccuugaaguuuaguaggaugaguauauagccuugucaucauaagcuccuugauguugggguacagugucauaguuaucuuugcuuuccucuaacaaguagcucaguuuuuaacuuuguguuuaugguugggaggugagcauggacugugguaggcagaagggcaaagauagcauuuacgugguggcaaggagcaccuuggcuaggccggagcgcuggguuccugugaacagacacuaguaggggauaaagccugggaacgugguuuggggucagauuauggauguccuugaauguaaggcugaggaguuuggacuuuauuuuuuaaauaguaggaacucauuaaaaagguuuuuagaugguagggaaaaccccauguaaaagacauucaaaauguguuugaauguggcacauuucucauucuauaaaacagugucagcuucuuaggaauuuuccugagugaaaguguugagaccugaacacuuuuaaaaagcaucuccagcuucguugauaaaaucuaggcuaucuuugcagugucaccugaauuuccucauuucuuuuuuuuucuuugagacagcaucucacucuguugcccaggcuggagugcagucuugggucacuguacucuccgccucccagguuuaagcaauucuccugccucagucucccaaguagcugggauuacaggugcccgccaccacgcccagcuaauuuuuguacuuuuaguagagauggggugucaccauguuggccaggcugguccucauuucuauuuucauccuugcucuacuggcgcaaccccucuaccuguguacugaauuuuguguuuuccaguuuccgaaggaauucugcucccauguuuccucccuucacuccugcauccucagcugagucuuauccuguggucuucagaaauguauaugucauuucagagaaaacucuuguuuuuuuucccgagagggaguuuugcucuuguugcccagguuggaguacaauggcgcaaucuccacucacugcaaccucuaccuccuggguucaagcgauucucuuuccucggccucccgaguagcugggauuacagauacccagcuaauuuuuaguauagacaggguuucaccauguuuggccaggcuggccuuaaacuccugaccucaggcaguccacccaccucagccucccgaagugcugagauuacaggugugagccaccacgcccggcccuguuucucuuuuauuucacccuuuccuucgaggaccucauccuuuucauugauucacuuuucugauacaacucuucaccccauaguauucaugcugccuuuugucaacacucuguuuuccuauucuuagcuuccagccuauuccuucacugggcaagccccuuccccuuacuuggggcauuuucucccuuugaagcuuuuucugaauuucugugacaugucauagucuauacugcauuauuuaguaccugauuacauaaucucucauugguaccuuuauuguuucaauuaugauuugcuuuucagaaucuucuugaggguagggaccauaaacguagugcugacacuuaacaccuauggauugaguauaucuacuuuuauagagagcugaagccaguguuuaucuugggaaauuuagaauucagacauuuuuuccauagccauuauacaguauaaguaaugguuaaguaaaaccaauacuugaaaaaucagaugaugaaaaaaucuggaagaacuaugagaauucauguacuuuacaaaaauagcuauucuguaguugaacaauauuaacaaaauucugauuaaaauauuagauauuauuuguaugugacuuaccaauacugaaaaaugaaaugaaguucuacacccagauccaaaggagucuuuaaggcacauaucucacacgcacauguguuaaugugguauuagacacuucucugcuuuucggggucccuauaaucaguuuuaauuuucuuuacagauguuucuauacuuugaagaucauggacuagugacgugcuccgcugaucaucucauuauuuuguggaaaaauggagagcgagaaucuggauugcgcaguuuaagauuauuucaaaaauuagaggagaauggugacuuauaccuugcugucuaguuuaaggaauuaaaaauacacaugcaugaaccuugaacaucaaauaucggguacuacucugaaaaccauuaauauauugaucacuuaaauugguaauuuuuuuugucaguccauaaaauucuacauguuuaaauuuuuuguggaccuaccaaccaggaacauguugcuucucagguccuaguauauccuccaaagaauauaccacaaguuuuuccauuugacuuugagcugcuguugaaguggugagugcuguguuuugagcuuauuuugaaccuagauccuugugaaagguacaaauagagguaauaguuaaguuauggcauuuauuagaaguuuuauuauuuggcuuccuuuagaauuauugugaaguuuaaaaauagccuuucuccugcaaauuuuccuagucuuuaguaacuguuaguguucuauauagcacaaacuugaaucucucagccaaaaaagggaacauauauacuguuuaaguauggcaaguuuucuuugguaccaauuuguuuagauaauuuuaaaaauguuuuuuaguucuagcuacuaaaaccuguaugaacucaaauggauaggcaucuugugaggguguguuuuucccagugugaauuggcuugaagagccaugggcuaaauggguacuagaacaacaacugccccucauguacgccaaggaugagcucuagaucauuugagaggcacaguguuuccggagucagggacugcagcugagcgcaacugccccaucugaccacugacucaaauacgaacugcuugagacagacuucuuuuauguaguucuuugcaguguccauugagacacuauaaccagccuuguaacaauauguuuucuccuuuuggugcuaaaaaaugaaaauauuagaaagua

SEQ ID NO: 192448 - RNA, 16308 nt, Homo sapiens
uaaguuguaaaaaaaauuuuguuauuuauaaaucaauuacacaauaaaauaauuauuuuuaaaagucacaaauacaaucguuguauaaagucauuuuggcaucaaguaucucuuaaauauguugcaaacuauuuuccaaagagaugugguccaaacccucugaaggcuuuauaauuuuguauuagauaacaagugaacaaaacugacaauaaauacuccaacaauuauuuuuuaaaauacuaaguggcaaaugcuauucuaaguggcaaaacaaucuauuacucagacuaccugaaaauuucacugaagucaucaaaaguuauacaaaauuuguauuuacauguuuaaaauccugauugcauuuuucuuuaauaauaauacauacaaaaacucagaggguuaauaaagaaauaauucaaaguccuaauaagucaacaaacagauuucauuauaagcugaacauaaaagagacaccauuguuugcuucucuuuucaaaaauuaucacggcacuuugucaaauggaagcagcauucagaacaaugguucucaaaucucugugugcauaaacaccaugcagguuuguaccacacagauuccugggcccuguucccagucugagcucucauuauugaaucugaggaaucugcauuuugaacaagauucacgacuauuuuauuuuauuuuaucacccaagcuggagugcaguggugcaaucucggcucacugcaaccucugccuccugaguuaaagugauacucaauucuugugccucagccuccugaguaacugggauuacaaacgugcaccacacaccugguuaacuuuuguauuuuuaguagagaugagguuucgccaugauggccaggcuggucucgaacuccugaccucaagugauugccugccucagccucccaaagugcuaggauuacaggcaugaggcaccgcacccagccaagauccaugauuuugaugaagugguacaagaaccucacucacuggacauugaaauucuacuguccaaucccaacucacugcuguugauuggaaaccugauucuggcagcucauuuaucuugguuuccucauuuguaaggucguucaguuggacugaucaucucugagggccuugaagcccuaacaagucuaucaugaucccagauguaaaauauauauauguguauauauauaauuucagcugagaagugagucuucacaccaagucuacuuuuugcaaguuacuggguuucugucuucaccaucuucugaaaagucugcuucuguugguucaguuucuggggucaucugaguagagagauucugaaacagacacugauguuaauuugggggacuacuuuucucaugcaaacaggggagcuccuagcaauccugagaggugcugcauccacaugguauguggugagaccuuuuugauuaggaaauaacagacacguccucauaacauuaaacagguuccacauccuacugugcaauucccaucugaggaccuggaaaacucaauaggaggucuuaacagugguugaacuugaagaguaagagcuggauuuccuggaguguuucuuugaggugagggauacuugcaucugcuuuacagugcggacacuucggcaaaggagagcguucuuugcaugaucccugaaaucaugugaaacaaaguaauagacaaaggggucgaugcagcuguuaaggguagagaggcagagggcuacaauguacagggcauagacauggcucuggcccuggcucuuaaucagaaaauaaugcaccacaagcagaagguuacuaggagugaagcagaucagguacauggccaggacagugacaaugaguuugauggcccucuuccuuuucuucucugaguuuucauccauggcagaagaucgcagcauucugaucaucagcacauaggcagaggcugugaggaaggcugggaacagaaagaccccaauggccagagagaggaaguaauugaacaugucucccaccaagagcugcucaggcaaaacaucaugacaggucgugauguucagggcaggaaugaagauggucugcuucacgacauacaaaggaauggugaccagcagaaucagcagccauauugccagggagaugccaauggcaauguuugccuucuuccuggagugccccaugggguucacgaugacccaauaccucugcacacugaggcaggucaugaagagaauggaacaguacauguugccauagaaaaagccaauaagcacauuacaaagagcuuccccauaaauccaguuguugccauguaugugauaggcaaucuucaaggggaaccagaugacagagaggaggucagccaaggccagauuggccauguaaaucacagcagggugcuucuucuuaguucggaaaagaaagacccacagggccaugccguuacuuggcaaacccaccacaaacacaauuguguagacaauuggaaggaagacaguggucaguuuuccagugaggacagaugcagaaaacucauccacagaaaagacuguuucaacuguaacuccuuuuccagugacgugggaugugccaucaaccuuaccaauaaggcuucuuccuuuagaggaucuacugguuccuguacaagaaaggaagacaagggucauuacagaaauaaauguuucagcaguaacacugguuuguucaaaugaaaguacauucauuuauucauuuuuuaauuuaugagacagggucucgcugucacccaggcuggagcguaguggagcgaucauaaugcaccgcagccucaaacuuuugggcucaagcaauccuccuaaacagccaggccacaggcacacaccaucacacccagcuaauuuuuuacuuuuuguagagauaggaucucacuauguugcccaggcuguucucaaacuccuggccuuaagauucuccugccucagccucccaaaguggugagauacaagugugagccacugagcccagccucaaaugaaaguacuuuagaugaaaacagaaauguacuauuagaggauuacacaaaaugcuuauaggggcuuuucuuuguguaaugagauuauugggauuucuauugucugguuuaguuugguuuuauggguuuuuuucuuacagugaguauuuuuguaucggggaguuguaaggaguugugggaugcauguggagcaucgauuucuaggaauauaaagaagacuaacaauauuucaauuuauuuuuacaaacuguccacacucauuaguccccagcuauucuuuuuauuuuacuuauuauuuuuuuuuuuuuuagagauggggucuugcuauguugacuaagcuggucucgaacuccuggcuucaagugauccucccaucuuggccucccaaagugcuggaauuacaggugugagacaucacgcccagcucuagcuauucuuaucacaugaccaacaacaguccuuugauuuaucaauuaguaaaauuugguuuggcugggcaugguggcucaugcguguaaucucagcacuuugggaggcuaaggcagguggaucaccugaggucaggaguuucagaccagccuggcuaacauggcgaaacccugacucuguuaaaaauacaaaaauuagccaggcgcaggcgccuguaaucccagcuacuugggaggcugaggcagaagaaucgcuugaaccccggaaguggagguugcagugauccaagaucaugccacugcacuucagccugggugacagagcgagccucagucaaaaaaaaaaaaaaaaaaucaguuuaggaaugugcaguaauuccuuucuaaauucucaaguguguaaaauagcgauccccauccugacaccaguuuucuaauuucucacuucauaauggccuucuaucccacucuagcccugagccaggauccuuccuggccuauucaauucaucauacccuauucagagcuugccacagggagauuccaggaccacaagggacauucccuuuucacccacaacgauagccucaacaauggcagggauuuucccugcucaugugcugguuuccuggagaaugucccauggaggccaacuggcagggaaaccgucuggccuggauagguggcuguacugaugacagacuuucaagcauguagcaugacaagcuaacuuauuaucccucucuuauauuaugaaguugaccuaaaaaccacaaagaaaugaauggcauguccucccuacauucugccccuaaguauucaugaaccugcaggaguaaguaaggacaauauaaggauacugaauaauuuuacucuaauucuggggaaaaguaggccucaccaagcagagaagacagggcaauacuugcacugccguauaccagggggauauuaaaccuacucaugcucuuaucucauaauguuaugcuuggucaucauuuuuccacuagaagcuuuacacuaauguuccgcagaauuuuucacaucuuaaugcuucccuauuugggaugcuagccuggguggaguguugggggauguagagaucaauauuucacuuuucacuuaguguaguggguugaaagguggugcccccaaaagagaagucuauguccuaaucgccagacucugugaacauuauuuagcaaaaaugucuuugcagauagaauuaaggauccuaagauaagaagaucucccuggguuaucuaggcgggcccuaaauccaaugacaagugucguuucuaagauaaaggcagaggccuggcguggugucucacgccuguaaucccagcacuuugggaggcugagguggguggaucacgaggucagaaguucaagacaagccuggccaacauagugaaacccugucucuacuaaaaauacaaaaauuagccgggcgugguggcaggcgccuguaguucuagcuacuugggaggcugaggcaggagaauugcuugaaccugggaggcggagguugcagugagccaagauugcgccacugcacuccagccugggcgacagaguuaaagucuguaucaaacaacaaaacagagagaaaagcagaaagagaucugcaacacgcagaaaaggagaagccagaggagugagugacaugagaauggaggcagagauuggagucacaucaaggaacaggccaagaaugccaagaaaugccagcagccacugcaagcuggaaaaggcaaggaauggacucucccuuagagcuuuuggagggcuuguggccccaauuccuugauuucagacuucuggucuccagaacugacagaauaaauguguuguuuuacaucaucaguuuauggcaauuugcuaugguagccacaagaaacuaauaugcuuaggauaguccuauuucuagugguucuauuuuuuuuauauaauucuucaaaaagaacauauguuguuuuuaaauuuaaaaaaaauuccuacauauuacaguguucuucaaauauuugaccauaaccccuaagaaccauauuccacauacuaacccaguucccaauacacauauccaugguggaaaaacguuucacaaaauaauaauuauucuuauuacauagggugcacugauacuuucuauuguauucuauuccauuauuauaaaaagccaguuauuauucuuuaacacugauuucacaggccacuuaacuuagaaugacaauguauguaacaauuagaaaguaacauacuggaaauuaauuugguguuggauucagugcuugauuaguguuauagacugagcaacuggugcaguuauuguggaaauuauccaacaccaaauuaauggaaaugaagggggcaaaguguuaaacaacaccacaaauguagucaguaaaauugagacucugggaacugcuacaggauaaaggaccuguuuuuuacaaaauauaaauuauaaggcaaaaaauaagaaagagggccaggcacagugccucaugccuucaauacccagcacuuugagaggccaaagcaggaggauugauugagaccaggaguucaagaccagccagggcaacauagcacaaugccaucucuucaaaaaaaaaaaaaagaagaagaagaagaacaaagguaaaaaaaagguguggaggugaaauuuauagaguagaagauuuaaaagacauaucagucauauaauguguguaccuuguuucaauccugauucaaacaaaccauaaaaauaacuuguuuuuuuuuuugagauggagucuuacucugucgcccaggcuggagugcaguggugcgaucuugguucacugcaaccuccgucucccagguucaagcaauucuccugccucagcuucccaaggagcugggauuacaggugcacaccacuacauccagcuaauuuuuguauuuuuaguagagaugggguuucaccauguuggucaagcuggucucgaacuccugaucucaagugaucugcccaccugagccucccaaagugcuggaauuacaggcaugagccacugcacccggccuaaaauaacauuuauaagacaauuagaaauuugaacacaaagccaggcacgguuguucaugccuauaaucccagugcuuugcgaggcugacguggaaggauugcucgaggccaagaguuugagaccagccuggccaacauagcaagaccgugucucuacaaaaaauuaaaaaaaaaaaaaauuagccaggcaugguggcgcacaccuguaguccuggauacuuggaaaguugaaacaggaagaucacuugagaccaggaguucaaugauucagugagauugugccacugcacuccacucugggugacagagugaggccccugucucuauauuaaaaaaaaaaaaaaaagaaagaaauuugaauacugacugaauauuugauuauauuaaaaauuaauguuaguagauacuauaauggcauuauguuuauauuugaaaaagaaaucccucauacuuuauuaauacauucuaaaauacuuuaggaugaaauuauaucugagauuuauuucacaaccacaggaauugaaacucucagacacugcugguaggaauacgaacuggugcacggcugggcagaguagcucacaccucuaaucccagcacuauuggaggccgagguggguggaucaccugaggucaggaguucgagaccagccuggccaacauggugaaaccccaucucuacuaaaaauacaaaaauuagucaggugugguggcauacaccuauaaucccagcaacuugggagggugagacaggagaaucauuugaaccgggaggcacagguugcaaugagccaagaucacgccauugcacuccagccugggcgacagagugaaaccaugucuauuuaaaauaaauaaaauaaaauaaaauaaaagguacaguuauugugggaaauuaucuggcaguuccucaaaugguuaaagaguuccuauauggcuggacgcaguggcucacgccuguaaucccagcaauuugggaggcugaggcaggcagaucacgaggucgggguuuugagcccaccuggcuaacauggugaaaccccaucucuauuaaaaauacaaaaauuagcugggugugguggcacacgccuauagucccagcuacucgggaagcugagacaggagaaucauuugaacuugggaggcggagguugcagugagccuagacugugccauugcacucugggcaacagagcaugacuccgucucaaaaaaaaaaaaaaaaaaaaaaguuacuauaugacccaguagcuccacucccagguaugcaggaguccacacaaaaaccuguacacaaauguucauagcagcauuauuuguuuuuguuuuuuuuuugagacggagucucgcugucgcccaggcuggagugcaguggcgcgaucucggcucaccgcaagcuccgccucccggguucaugccauucuccugccucagccuccccaguagcugggacuacaggcgccugccaccacgccuggcuaauuuuuuuuuuuuuuuuuuuuuuuuguauuuuuaguagagaugggguuucacaguguuagccaggauggucucgaucuccugaccuugugauccgcccaccucggccucccaaagugcugggauuacaggcgugagccaccacgcccagccauagcagcauuauaauauagcacugugcccagcccacagucaacaagugggcugggcacaguggugcucaccuguaauccuaucacuuugggaggaugagaugggagaagugcuugaggccaggaauuugagacaagccugggcaacagagcagaaccccaucucuacaaacauuuuacaaaauuagccaggcauaguggugcacacuuguagucccacuacuaggaaggcugaggcaggaggacagcuugaaccuaggaggucagagauuacaccacugcacuccagccugggcaacagagcaggacccugucucaaaaaaaggaaaaaaaaguggaaacaauccaaauguccaucaacaauugaaaagaaauaaaaagcaguauauccauacaauggaauauuauuuggcuguuuucaaaaaucaaguacuugggaggcugaggcaggcagaucaccugaggucaggagcucaagaccagccuggccaacauggugaaacccagucucuacuaaaaauacaaaaauuagccagaggugguggugugggcccacagucccaacuacucaggaggcugaggcaggagaaucacuugaaacuagaggcaaagguugcagagauugcaccacugcacuccagccugggugacagagcaagacucugucucaaaaaaaaaaaaaaguacugauacauagauacauggaugaaucuccaaaagauuaugcuaagugaaagaagccagucacagaggacaacacauuaucccauuucuaucaaaugucuacaauaggcaaauccauaaauagaaaguagauuaguguuugccaagggcuaagaccagaagauuggugaaugacagcuaaacuguuucuuccaggguaauaaaaauguucuaaaauugugguaaugguugaauaauucuaugaacauccuaaaagccacuaaauuguacaguuuaaaggggugaauuguauggugugcaaauuaucugauauggaauucuugguaaagcuguuaaaaaaaaaacacaggcuuggcaucauaggaaagggaaaaaaacagaaaagaaauaacagggaagaggagugggaggugaguuugggaauagaugaaacaagauuagccaacaguuaauaauuauugaaguugagugguggauacacuuaauucacuauaauaguauauuucuauaagauuaaaauucuccauaaaaauaagcauguaccaagucaggaaagcucacauaaagagugcucaaaaucuguuuuaaauaagaaugcuaaaauaaagaccaaaaaaggagcaaggaauggcaauauaacaauuuuuuuuuaaaaaggaacuuuuucuuagaauauuucaacacauaaccuuuaauggucuccaucaaaacuauuguugauauuaacuguucuauaacacugguaaaugucaagaugcuacucgaaggucccugaagcccuugcccagugcauuugcucugacucuguacaggguccuuaccacucaccaaaacucacagagcuugucuagagaaccgaugcuaucccagcucccaauugucaaccagguaaaaucauuucuauuucacagaguugaggagagacuaaaugcacaaaugaaguuuaaacacaaauaaagugccuggcuacaauuacauucccauuucuagggcuguaauaaacaauuauugcccaagugugugaaaauacacacucacagaugcucaaggcagcauccccccacucaguuacagacaaacagcuccuuauuucuauuccuaacuuagcaugucccugacguagucccuacuacuaaggguagacaauauaguagccaauaauauugaaauggaaagacagccacaauauacagucaauugaaaaaagaaacuggccaggcaugguggcucacaccuguaaucccagcacuuugggaggccgaggcggguggauccugagaucaagagaucgagaccauccugaccaacauggugaaacccaaucucuacuaaaaaauacaaaaauuagcuaaguguagugcacgcgccuguagucccagcuacuccagaggcugaggcaggagaaucgcuugaacccagaaggcagagguugcagugagccgagaucaugccacugcacuucagccuggcaacagagugagacucugucucaaaaaaaaaaaaaaaaaaaaauuauaauguacaauuugcaaaaucugaagucuagaaggauauccaccaaacaauaaaaaguggcuggcucuguggaguagaauagcuggggacaagagaacuuuucuuuuuauuuuacaccucucuauauuauuugaauuuuguaucucaaaggaauauaaauugauauaauauuuuugguggguaauuuggcaaaacauaucaaaauuuuaaauguauuugccauaugaccuagcaauuuacuucuaggaauuugcccugcaccuaccagcuaaagugcacaaagcuauuuuauguacuagaauauucacuggaacauuguuuagcaugguaaaacaauguuaauuucaacaucuaucaaaaaggggaguaguucaggcccuggcaggguggcucacgccuguaaacccagcacuuugggaggcuaaggcgggcggaucaugagaucgggaguuugagaucagcguggccaacauggugaaaccccgucucuacuaaaaauacaaaaauuagcugggugugguggcgggcaccuguaaucccagcuacuugggaggcugaaccugggaggcuugaaccugggaggcggagguugcagugagcugagaucacaccacugcacuccagccugggugacagagcaagacuucaucugggguucggggaugggcgggaagaggggaguaguucaggccaggcauaguggcaaccuagccauagccccagcuacuugggagcuccgucuaaaaaaaaaauuagcugggggugagcuaugauccugccacugcacuccagcuugggugacagccagacccagucucuuuaaaaaaaaaagggggggggggugugguggggaggacuaguucaauuaccccccuauaaaaguuuguacagggucggcgcaguggcucacgccuguaaucccagcacuuugggaggccgaggcaggugggucacgaggucaggagaccgagaccauccuggcuaacacgguuaaacccugucucuacuaaaaauacaaaaaauuagccgggcaugguggcgggcgucuguagucccagcugcuugggaggcuguggcaggagaauggcaugaacccgggaggcagagcuuacagcgagcugagauagcgccccuucacuccagccugggcgacacggcaagacuccgucucaaaaaaaaaaaaaaaaaguuuguacagauuucuauaaacugacuaugaaucgauuagguaaaaaagauaaauaaaucauagcacaguauguacaguacgguaugcuccuucuauuccuauaaaucauuugugcauagagaaguugagcugauggccaggaauagugacucacaccuauaaucccagcacuuugggaggccaaggcgggcggaucacuugaggucaggaauucaagaccagccuggccaacauggcaaaauucuggcuuuacuaaaaaugcaaaaauuagcuggagguguuggcgcgcaucuguaaucccaucuacuugagaggcugaggcaggagaaucacuucaaccuggaaagcgcagguugcagugagcugagaucacaucacugcacuccagcccuccagccugggcgacacagcgagacuccaucucaaaaaaaaaaaaaaaaaaccaaccaaccaaacaaacaaaacccgagaaguugugcugagauuggagaccagaaagaaugagagauuuucacuuuuuuuuagacccuucugauuuacacaauuuugggaaaaucugcguguaaaacuuuuuuuuuuuuuugagacugagucucacucuguugccccggcuggagugcagaggcacgaucucggcucacugcaagcucgaccucccggguucacgccauucuccugccucagccucccaagcagcugggacuacaggcgcccgccaccaugcccggcuaauuuuuuguauuuuuaguagagacaggguuucaccauguuagccaggauggucuugaucuccugaccuugugauccacccgccuugacuuccaaagugcugggauuacaggcgugagccaccacgcuuggccuaaaacuuuuaauuuaauuuuuauuuuaaguauacuccucuuguggcccaaccuccccaucaaaccaaguguaaaacaagcacuuuacuugcauuaguucucuuccuuucacccucucuucucuaugauccccucaccccaaauguccuuuuuugcucccaaucuuugggagcacagacugaaaaauaaagguuucaauuguggggugccccucccuagcuaaacuuuuaguacauuuucagaaguguucuuucagaaugaacuguuuucuucaacacuugccaagcuaauaaaaccauaagaaagucaaauacagauuuacuaaaacaucaucuaucaagguuauuuaguaacuacaaagcaagcaaaaggaucaaauuuaaaguccuaucuuccaguucauugcaguguucugucauauuacaaaacuuuggccaggcacgguggcucaugccuauaaucccagcacuuugggaggcugaggcagguggaucacuugaggucaggaguucaagaucagccuggccaacguggcgaaaccccguuuauaccaaaaacacaaaaauuaguuggaugugguggugugcgccuguagucccagcuacuccagaggcugaggcaugagaaucacuuaaaccugggaggcagagguugcagugagccgagaucgugccacugcacuacagccugggcaacagagugagauucuaucucagggggaaaaaaaaaauggaaauaccacaugucuaucaacaaaggacuaauuuuaaaauugaugcauccuucuguaacauuuuggagucauuaaaaauguuuuauauguauugacaugauacugaugugcuuauauaaucccauacuugcacaaacauauuuucuguauuugugaauacauauuuugugcauggauguaauaaagagugggaaaauauauaagccgaaauauuagcgguggcuacuuugguacugaaguucagggugauuuaauuaaauguuuccuuuuuuuguuuuggcucauuuuucccucgagugaucacauauuguuuuuauaauuuaaaaaacaauuauagguagggcgcaguagcucaugccuguaaucccagcacuuugggaggcugaagguggguggaucaccugaggucaggaguuugagaucagccugaccaauauggugaaacccugucucuacuaaaaauacaaaaauuagcugggggugguggugcgugccugucgucccagcuacucgggaggcugcagcaggagacuuccuugagcccgggagagguggagguugcaaugagccaaaauugcaccacugcacucaagccugggcaaccgaaugagagucaaaaaaaaaaaaaacccaaaaaaccaaaaaaacaaaaaaaaaccaccaaaccaauuauaaagaaaacagaaguuccagucuccaaaagauaaauggaaugaccuaggccuguaacaugguggaaaaaaauaaguaaguggcagagagaagcugacugaaaugaacaccacauggaccagccaggguacucugggcaagacuccucacuucauucauuugcuauuuacugaggucccguaggugaugagacuaugcuagacgugauggaaaggaugguagggcccccugccuccaggaguuaacgaugcagugaggacacauauuaagcauguuuacccaaauaauuaucaauuacuauuguaaagggaaagagaagcccugauuuccaaguguuuuccuugccuugccuccucaauucaguguccuucaccuguacccugagaagguugugaucucggcugaguucguuucuaugaggcagucuuuuggagugaggcuuugggaagaaaaucaaaccccaaaucggcccugcagccaccugaggggcacgcagaaggaccggcuaaaaagcgagugagcaaagacccacccugagggcagaaaagcuuugcuaacacuguauuucuuauuaaaaucaauuuaguuuuaaggugggaggaaagcuccaucugccuaaaucaauugucaguguuacuucacuaacccuuugggaaaguuacuuugcaagggaauaaaaguaugguggggggaggaugaggaacaaggugcaauauuaaguggcuauaguuaacaaguaaccugauuuuuccuuauuguuaaaucaaguucgccuuauaauccagggaucucccaaucccccaagaguaguaaacaagaacaagacaaauaaucggggcaugcuuccuacagggaucucugaaucauaaagauguugaaucagcuauaccaacauguauuuuuuuaaaguuugcacauacuaaccuuugcuccugaauuuuaaguuuccaacuuuaaaggacauagaggagagguguccauuacaguuuucaauacuuccuggaacuaaaugccuuuauucugaugcugauuaagaaaaaaaaauauaccagcggugcacaguuuucaagcuuacaccauuaacacccuuuucccuaacugcagagggaaaagaaucacauucuuccaucuaauuccaacccacugugacuugcucuuuuacuucgucuuuaugaagaggaggauaaaagugagaaaugcgcauuucugagggaaauuaaaagcucccuuugcuacccaggcugccccaaacagaggggccucgguuaggaucacaguggcgcgaucgcaggucaaacaucccccacggccacagcgaggccugcugggcccggaagaacacacucccagcaauacaaguucgagcacacccggagcagcacauccaaggaacgcgacggccgggcgcaagugcugcucuguucccaggccagccagccucuggccugcagaccuggguggcagccaguggccgcuccggguggcacacuaggaaagucccggaaccccaggcccagagggucaacuggucaaauauaaggcaggguccaaaaaguuccgcucguaaauccucguggcgcccaacgggccugagcgcucauuaccaccagaacccaucagggaccggcccugacuuucauaccccgggccuuccacugugggugccaggagcagcgggacccgggugggucucgaacgcaggggccagaacccgaagaaaggcuuccagcaguuggagagggacgcaaaaaacaaccuagaaggcucccgggccgcggguucccacccacuccgcccugcccugcgcaaucagcucgcuaaccccaccggccccgcggggccagcggaggaagucuccggaguuggcaaaaagcucuuaaugacuuaguguuuacaaagcaaccaagcccggggaggggacuagguccucugcguacccuuuagacacagcuacuccuuccuucccucccuuuccccgaacccacgcuggggccuggaggugcccagcaugacagccucuacgggaaguggggucuuuggggaaaucucugccucugcccggcuccgcugacuucagcugcucccgcaugucccaccugggugccuccuuggcgcagagaccucacaucaaagccaccaaggggaggcuaagggauucguagagaugggugccggcagcagaacagccuucgcacaccugcccggaucccaccgucugcccagcgugcccaggaccccagcuccucagagauaagagcccuccuuggccagguuucucaccuuggauggugccacugcaggagagagaggcugcuagcaggauggcggcccccagcagccacgccgcgcuggggcuccgcauccuccuggaagccccgacgccgggcgcgcggggaauccgccgccgccgauucgaaacucagagcuccacuggacgcaccgagagaaagucagccucucaccugccccgaaucggagccucugcugcgcgccuccccagggcggguuagguuucagggaaaccgaaggagcagcgu

SEQ ID NO: 192449 - RNA, 16308 nt, Homo sapiens
acgcugcuccuucgguuucccugaaaccuaacccgcccuggggaggcgcgcagcagaggcuccgauucggggcaggugagaggcugacuuucucucggugcguccaguggagcucugaguuucgaaucggcggcggcggauuccccgcgcgcccggcgucggggcuuccaggaggaugcggagccccagcgcggcguggcugcugggggccgccauccugcuagcagccucucucuccugcaguggcaccauccaaggugagaaaccuggccaaggagggcucuuaucucugaggagcugggguccugggcacgcugggcagacggugggauccgggcaggugugcgaaggcuguucugcugccggcacccaucucuacgaaucccuuagccuccccuugguggcuuugaugugaggucucugcgccaaggaggcacccaggugggacaugcgggagcagcugaagucagcggagccgggcagaggcagagauuuccccaaagaccccacuucccguagaggcugucaugcugggcaccuccaggccccagcguggguucggggaaagggagggaaggaaggaguagcugugucuaaaggguacgcagaggaccuaguccccuccccgggcuugguugcuuuguaaacacuaagucauuaagagcuuuuugccaacuccggagacuuccuccgcuggccccgcggggccggugggguuagcgagcugauugcgcagggcagggcggagugggugggaacccgcggcccgggagccuucuagguuguuuuuugcgucccucuccaacugcuggaagccuuucuucggguucuggccccugcguucgagacccacccgggucccgcugcuccuggcacccacaguggaaggcccgggguaugaaagucagggccggucccugauggguucuggugguaaugagcgcucaggcccguugggcgccacgaggauuuacgagcggaacuuuuuggacccugccuuauauuugaccaguugacccucugggccugggguuccgggacuuuccuagugugccacccggagcggccacuggcugccacccaggucugcaggccagaggcuggcuggccugggaacagagcagcacuugcgcccggccgucgcguuccuuggaugugcugcuccgggugugcucgaacuuguauugcugggaguguguucuuccgggcccagcaggccucgcuguggccgugggggauguuugaccugcgaucgcgccacugugauccuaaccgaggccccucuguuuggggcagccuggguagcaaagggagcuuuuaauuucccucagaaaugcgcauuucucacuuuuauccuccucuucauaaagacgaaguaaaagagcaagucacaguggguuggaauuagauggaagaaugugauucuuuucccucugcaguuagggaaaaggguguuaaugguguaagcuugaaaacugugcaccgcugguauauuuuuuuuucuuaaucagcaucagaauaaaggcauuuaguuccaggaaguauugaaaacuguaauggacaccucuccucuauguccuuuaaaguuggaaacuuaaaauucaggagcaaagguuaguaugugcaaacuuuaaaaaaauacauguugguauagcugauucaacaucuuuaugauucagagaucccuguaggaagcaugccccgauuauuugucuuguucuuguuuacuacucuugggggauugggagaucccuggauuauaaggcgaacuugauuuaacaauaaggaaaaaucagguuacuuguuaacuauagccacuuaauauugcaccuuguuccucauccuccccccaccauacuuuuauucccuugcaaaguaacuuucccaaaggguuagugaaguaacacugacaauugauuuaggcagauggagcuuuccucccaccuuaaaacuaaauugauuuuaauaagaaauacaguguuagcaaagcuuuucugcccucagggugggucuuugcucacucgcuuuuuagccgguccuucugcgugccccucagguggcugcagggccgauuugggguuugauuuucuucccaaagccucacuccaaaagacugccucauagaaacgaacucagccgagaucacaaccuucucaggguacaggugaaggacacugaauugaggaggcaaggcaaggaaaacacuuggaaaucagggcuucucuuucccuuuacaauaguaauugauaauuauuuggguaaacaugcuuaauauguguccucacugcaucguuaacuccuggaggcagggggcccuaccauccuuuccaucacgucuagcauagucucaucaccuacgggaccucaguaaauagcaaaugaaugaagugaggagucuugcccagaguacccuggcugguccaugugguguucauuucagucagcuucucucugccacuuacuuauuuuuuuccaccauguuacaggccuaggucauuccauuuaucuuuuggagacuggaacuucuguuuucuuuauaauugguuuggugguuuuuuuuuguuuuuuugguuuuuuggguuuuuuuuuuuuuugacucucauucgguugcccaggcuugagugcaguggugcaauuuuggcucauugcaaccuccaccucucccgggcucaaggaagucuccugcugcagccucccgaguagcugggacgacaggcacgcaccaccacccccagcuaauuuuuguauuuuuaguagagacaggguuucaccauauuggucaggcugaucucaaacuccugaccucaggugauccacccaccuucagccucccaaagugcugggauuacaggcaugagcuacugcgcccuaccuauaauuguuuuuuaaauuauaaaaacaauaugugaucacucgagggaaaaaugagccaaaacaaaaaaaggaaacauuuaauuaaaucacccugaacuucaguaccaaaguagccaccgcuaauauuucggcuuauauauuuucccacucuuuauuacauccaugcacaaaauauguauucacaaauacagaaaauauguuugugcaaguaugggauuauauaagcacaucaguaucaugucaauacauauaaaacauuuuuaaugacuccaaaauguuacagaaggaugcaucaauuuuaaaauuaguccuuuguugauagacaugugguauuuccauuuuuuuuuucccccugagauagaaucucacucuguugcccaggcuguagugcaguggcacgaucucggcucacugcaaccucugccucccagguuuaagugauucucaugccucagccucuggaguagcugggacuacaggcgcacaccaccacauccaacuaauuuuuguguuuuugguauaaacgggguuucgccacguuggccaggcugaucuugaacuccugaccucaagugauccaccugccucagccucccaaagugcugggauuauaggcaugagccaccgugccuggccaaaguuuuguaauaugacagaacacugcaaugaacuggaagauaggacuuuaaauuugauccuuuugcuugcuuuguaguuacuaaauaaccuugauagaugauguuuuaguaaaucuguauuugacuuucuuaugguuuuauuagcuuggcaaguguugaagaaaacaguucauucugaaagaacacuucugaaaauguacuaaaaguuuagcuagggaggggcaccccacaauugaaaccuuuauuuuucagucugugcucccaaagauugggagcaaaaaaggacauuuggggugaggggaucauagagaagagagggugaaaggaagagaacuaaugcaaguaaagugcuuguuuuacacuugguuugauggggagguugggccacaagaggaguauacuuaaaauaaaaauuaaauuaaaaguuuuaggccaagcgugguggcucacgccuguaaucccagcacuuuggaagucaaggcggguggaucacaaggucaggagaucaagaccauccuggcuaacauggugaaacccugucucuacuaaaaauacaaaaaauuagccgggcaugguggcgggcgccuguagucccagcugcuugggaggcugaggcaggagaauggcgugaacccgggaggucgagcuugcagugagccgagaucgugccucugcacuccagccggggcaacagagugagacucagucucaaaaaaaaaaaaaaguuuuacacgcagauuuucccaaaauuguguaaaucagaagggucuaaaaaaaagugaaaaucucucauucuuucuggucuccaaucucagcacaacuucucggguuuuguuuguuugguugguugguuuuuuuuuuuuuuuuuugagauggagucucgcugugucgcccaggcuggagggcuggagugcagugaugugaucucagcucacugcaaccugcgcuuuccagguugaagugauucuccugccucagccucucaaguagaugggauuacagaugcgcgccaacaccuccagcuaauuuuugcauuuuuaguaaagccagaauuuugccauguuggccaggcuggucuugaauuccugaccucaagugauccgcccgccuuggccucccaaagugcugggauuauaggugugagucacuauuccuggccaucagcucaacuucucuaugcacaaaugauuuauaggaauagaaggagcauaccguacuguacauacugugcuaugauuuauuuaucuuuuuuaccuaaucgauucauagucaguuuauagaaaucuguacaaacuuuuuuuuuuuuuuuuugagacggagucuugccgugucgcccaggcuggagugaaggggcgcuaucucagcucgcuguaagcucugccucccggguucaugccauucuccugccacagccucccaagcagcugggacuacagacgcccgccaccaugcccggcuaauuuuuuguauuuuuaguagagacaggguuuaaccguguuagccaggauggucucggucuccugaccucgugacccaccugccucggccucccaaagugcugggauuacaggcgugagccacugcgccgacccuguacaaacuuuuauagggggguaauugaacuaguccuccccaccacacccccccccccuuuuuuuuuuaaagagacugggucuggcugucacccaagcuggagugcaguggcaggaucauagcucacccccagcuaauuuuuuuuuuagacggagcucccaaguagcuggggcuauggcuagguugccacuaugccuggccugaacuacuccccucuucccgcccauccccgaaccccagaugaagucuugcucugucacccaggcuggagugcaguggugugaucucagcucacugcaaccuccgccucccagguucaagccucccagguucagccucccaaguagcugggauuacaggugcccgccaccacacccagcuaauuuuuguauuuuuaguagagacgggguuucaccauguuggccacgcugaucucaaacucccgaucucaugauccgcccgccuuagccucccaaagugcuggguuuacaggcgugagccacccugccagggccugaacuacuccccuuuuugauagauguugaaauuaacauuguuuuaccaugcuaaacaauguuccagugaauauucuaguacauaaaauagcuuugugcacuuuagcugguaggugcagggcaaauuccuagaaguaaauugcuaggucauauggcaaauacauuuaaaauuuugauauguuuugccaaauuacccaccaaaaauauuauaucaauuuauauuccuuugagauacaaaauucaaauaauauagagagguguaaaauaaaaagaaaaguucucuuguccccagcuauucuacuccacagagccagccacuuuuuauuguuugguggauauccuucuagacuucagauuuugcaaauuguacauuauaauuuuuuuuuuuuuuuuuuuuugagacagagucucacucuguugccaggcugaagugcaguggcaugaucucggcucacugcaaccucugccuucuggguucaagcgauucuccugccucagccucuggaguagcugggacuacaggcgcgugcacuacacuuagcuaauuuuuguauuuuuuaguagagauuggguuucaccauguuggucaggauggucucgaucucuugaucucaggauccacccgccucggccucccaaagugcugggauuacaggugugagccaccaugccuggccaguuucuuuuuucaauugacuguauauuguggcugucuuuccauuucaauauuauuggcuacuauauugucuacccuuaguaguagggacuacgucagggacaugcuaaguuaggaauagaaauaaggagcuguuugucuguaacugaguggggggaugcugccuugagcaucugugaguguguauuuucacacacuugggcaauaauuguuuauuacagcccuagaaaugggaauguaauuguagccaggcacuuuauuuguguuuaaacuucauuugugcauuuagucucuccucaacucugugaaauagaaaugauuuuaccugguugacaauugggagcugggauagcaucgguucucuagacaagcucugugaguuuuggugagugguaaggacccuguacagagucagagcaaaugcacugggcaagggcuucagggaccuucgaguagcaucuugacauuuaccaguguuauagaacaguuaauaucaacaauaguuuugauggagaccauuaaagguuauguguugaaauauucuaagaaaaaguuccuuuuuaaaaaaaaauuguuauauugccauuccuugcuccuuuuuuggucuuuauuuuagcauucuuauuuaaaacagauuuugagcacucuuuaugugagcuuuccugacuugguacaugcuuauuuuuauggagaauuuuaaucuuauagaaauauacuauuauagugaauuaaguguauccaccacucaacuucaauaauuauuaacuguuggcuaaucuuguuucaucuauucccaaacucaccucccacuccucuucccuguuauuucuuuucuguuuuuuucccuuuccuaugaugccaagccuguguuuuuuuuuuaacagcuuuaccaagaauuccauaucagauaauuugcacaccauacaauucaccccuuuaaacuguacaauuuaguggcuuuuaggauguucauagaauuauucaaccauuaccacaauuuuagaacauuuuuauuacccuggaagaaacaguuuagcugucauucaccaaucuucuggucuuagcccuuggcaaacacuaaucuacuuucuauuuauggauuugccuauuguagacauuugauagaaaugggauaauguguuguccucugugacuggcuucuuucacuuagcauaaucuuuuggagauucauccauguaucuauguaucaguacuuuuuuuuuuuuuugagacagagucuugcucugucacccaggcuggagugcaguggugcaaucucugcaaccuuugccucuaguuucaagugauucuccugccucagccuccugaguaguugggacugugggcccacaccaccaccucuggcuaauuuuuguauuuuuaguagagacuggguuucaccauguuggccaggcuggucuugagcuccugaccucaggugaucugccugccucagccucccaaguacuugauuuuugaaaacagccaaauaauauuccauuguauggauauacugcuuuuuauuucuuuucaauuguugauggacauuuggauuguuuccacuuuuuuuuccuuuuuuugagacaggguccugcucuguugcccaggcuggagugcagugguguaaucucugaccuccuagguucaagcuguccuccugccucagccuuccuaguagugggacuacaagugugcaccacuaugccuggcuaauuuuguaaaauguuuguagagaugggguucugcucuguugcccaggcuugucucaaauuccuggccucaagcacuucucccaucucauccucccaaagugauaggauuacaggugagcaccacugugcccagcccacuuguugacugugggcugggcacagugcuauauuauaaugcugcuauggcugggcgugguggcucacgccuguaaucccagcacuuugggaggccgaggugggcggaucacaaggucaggagaucgagaccauccuggcuaacacugugaaaccccaucucuacuaaaaauacaaaaaaaaaaaaaaaaaaaaaaaauuagccaggcgugguggcaggcgccuguagucccagcuacuggggaggcugaggcaggagaauggcaugaacccgggaggcggagcuugcggugagccgagaucgcgccacugcacuccagccugggcgacagcgagacuccgucucaaaaaaaaaacaaaaacaaauaaugcugcuaugaacauuuguguacagguuuuuguguggacuccugcauaccugggaguggagcuacugggucauauaguaacuuuuuuuuuuuuuuuuuuuuuugagacggagucaugcucuguugcccagagugcaauggcacagucuaggcucacugcaaccuccgccucccaaguucaaaugauucuccugucucagcuucccgaguagcugggacuauaggcgugugccaccacacccagcuaauuuuuguauuuuuaauagagaugggguuucaccauguuagccaggugggcucaaaaccccgaccucgugaucugccugccucagccucccaaauugcugggauuacaggcgugagccacugcguccagccauauaggaacucuuuaaccauuugaggaacugccagauaauuucccacaauaacuguaccuuuuauuuuauuuuauuuuauuuauuuuaaauagacaugguuucacucugucgcccaggcuggagugcaauggcgugaucuuggcucauugcaaccugugccucccgguucaaaugauucuccugucucacccucccaaguugcugggauuauagguguaugccaccacaccugacuaauuuuuguauuuuuaguagagaugggguuucaccauguuggccaggcuggucucgaacuccugaccucaggugauccacccaccucggccuccaauagugcugggauuagaggugugagcuacucugcccagccgugcaccaguucguauuccuaccagcagugucugagaguuucaauuccugugguugugaaauaaaucucagauauaauuucauccuaaaguauuuuagaauguauuaauaaaguaugagggauuucuuuuucaaauauaaacauaaugccauuauaguaucuacuaacauuaauuuuuaauauaaucaaauauucagucaguauucaaauuucuuucuuuuuuuuuuuuuuuuaauauagagacaggggccucacucugucacccagaguggagugcaguggcacaaucucacugaaucauugaacuccuggucucaagugaucuuccuguuucaacuuuccaaguauccaggacuacaggugugcgccaccaugccuggcuaauuuuuuuuuuuuuuaauuuuuuguagagacacggucuugcuauguuggccaggcuggucucaaacucuuggccucgagcaauccuuccacgucagccucgcaaagcacugggauuauaggcaugaacaaccgugccuggcuuuguguucaaauuucuaauugucuuauaaauguuauuuuaggccgggugcaguggcucaugccuguaauuccagcacuuugggaggcucaggugggcagaucacuugagaucaggaguucgagaccagcuugaccaacauggugaaaccccaucucuacuaaaaauacaaaaauuagcuggauguaguggugugcaccuguaaucccagcuccuugggaagcugaggcaggagaauugcuugaaccugggagacggagguugcagugaaccaagaucgcaccacugcacuccagccugggcgacagaguaagacuccaucucaaaaaaaaaaacaaguuauuuuuaugguuuguuugaaucaggauugaaacaagguacacacauuauaugacugauaugucuuuuaaaucuucuacucuauaaauuucaccuccacaccuuuuuuuuaccuuuguucuucuucuucuucuuuuuuuuuuuuuugaagagauggcauugugcuauguugcccuggcuggucuugaacuccuggucucaaucaauccuccugcuuuggccucucaaagugcuggguauugaaggcaugaggcacugugccuggcccucuuucuuauuuuuugccuuauaauuuauauuuuguaaaaaacagguccuuuauccuguagcaguucccagagucucaauuuuacugacuacauuugugguguuguuuaacacuuugcccccuucauuuccauuaauuugguguuggauaauuuccacaauaacugcaccaguugcucagucuauaacacuaaucaagcacugaauccaacaccaaauuaauuuccaguauguuacuuucuaauuguuacauacauugucauucuaaguuaaguggccugugaaaucaguguuaaagaauaauaacuggcuuuuuauaauaauggaauagaauacaauagaaaguaucagugcacccuauguaauaagaauaauuauuauuuugugaaacguuuuuccaccauggauauguguauugggaacuggguuaguauguggaauaugguucuuagggguuauggucaaauauuugaagaacacuguaauauguaggaauuuuuuuuaaauuuaaaaacaacauauguucuuuuugaagaauuauauaaaaaaaauagaaccacuagaaauaggacuauccuaagcauauuaguuucuuguggcuaccauagcaaauugccauaaacugaugauguaaaacaacacauuuauucugucaguucuggagaccagaagucugaaaucaaggaauuggggccacaagcccuccaaaagcucuaagggagaguccauuccuugccuuuuccagcuugcaguggcugcuggcauuucuuggcauucuuggccuguuccuugaugugacuccaaucucugccuccauucucaugucacucacuccucuggcuucuccuuuucugcguguugcagaucucuuucugcuuuucucucuguuuuguuguuugauacagacuuuaacucugucgcccaggcuggagugcaguggcgcaaucuuggcucacugcaaccuccgccucccagguucaagcaauucuccugccucagccucccaaguagcuagaacuacaggcgccugccaccacgcccggcuaauuuuuguauuuuuaguagagacaggguuucacuauguuggccaggcuugucuugaacuucugaccucgugauccacccaccucagccucccaaagugcugggauuacaggcgugagacaccacgccaggccucugccuuuaucuuagaaacgacacuugucauuggauuuagggcccgccuagauaacccagggagaucuucuuaucuuaggauccuuaauucuaucugcaaagacauuuuugcuaaauaauguucacagagucuggcgauuaggacauagacuucucuuuugggggcaccaccuuucaacccacuacacuaagugaaaagugaaauauugaucucuacaucccccaacacuccacccaggcuagcaucccaaauagggaagcauuaagaugugaaaaauucugcggaacauuaguguaaagcuucuaguggaaaaaugaugaccaagcauaacauuaugagauaagagcaugaguagguuuaauaucccccugguauacggcagugcaaguauugcccugucuucucugcuuggugaggccuacuuuuccccagaauuagaguaaaauuauucaguauccuuauauuguccuuacuuacuccugcagguucaugaauacuuaggggcagaauguagggaggacaugccauucauuucuuugugguuuuuaggucaacuucauaauauaagagagggauaauaaguuagcuugucaugcuacaugcuugaaagucugucaucaguacagccaccuauccaggccagacgguuucccugccaguuggccuccaugggacauucuccaggaaaccagcacaugagcagggaaaaucccugccauuguugaggcuaucguugugggugaaaagggaaugucccuugugguccuggaaucucccuguggcaagcucugaauaggguaugaugaauugaauaggccaggaaggauccuggcucagggcuagagugggauagaaggccauuaugaagugagaaauuagaaaacuggugucaggauggggaucgcuauuuuacacacuugagaauuuagaaaggaauuacugcacauuccuaaacugauuuuuuuuuuuuuuuuuugacugaggcucgcucugucacccaggcugaagugcaguggcaugaucuuggaucacugcaaccuccacuuccgggguucaagcgauucuucugccucagccucccaaguagcugggauuacaggcgccugcgccuggcuaauuuuuguauuuuuaacagagucaggguuucgccauguuagccaggcuggucugaaacuccugaccucaggugauccaccugccuuagccucccaaagugcugagauuacacgcaugagccaccaugcccagccaaaccaaauuuuacuaauugauaaaucaaaggacuguuguuggucaugugauaagaauagcuagagcugggcgugaugucucacaccuguaauuccagcacuuugggaggccaagaugggaggaucacuugaagccaggaguucgagaccagcuuagucaacauagcaagaccccaucucuaaaaaaaaaaaaaauaauaaguaaaauaaaaagaauagcuggggacuaaugaguguggacaguuuguaaaaauaaauugaaauauuguuagucuucuuuauauuccuagaaaucgaugcuccacaugcaucccacaacuccuuacaacuccccgauacaaaaauacucacuguaagaaaaaaacccauaaaaccaaacuaaaccagacaauagaaaucccaauaaucucauuacacaaagaaaagccccuauaagcauuuuguguaauccucuaauaguacauuucuguuuucaucuaaaguacuuucauuugaggcugggcucaguggcucacacuuguaucucaccacuuugggaggcugaggcaggagaaucuuaaggccaggaguuugagaacagccugggcaacauagugagauccuaucucuacaaaaaguaaaaaauuagcugggugugauggugugugccuguggccuggcuguuuaggaggauugcuugagcccaaaaguuugaggcugcggugcauuaugaucgcuccacuacgcuccagccugggugacagcgagacccugucucauaaauuaaaaaaugaauaaaugaauguacuuucauuugaacaaaccaguguuacugcugaaacauuuauuucuguaaugacccuugucuuccuuucuuguacaggaaccaguagauccucuaaaggaagaagccuuauugguaagguugauggcacaucccacgucacuggaaaaggaguuacaguugaaacagucuuuucuguggaugaguuuucugcaucuguccucacuggaaaacugaccacugucuuccuuccaauugucuacacaauuguguuugugguggguuugccaaguaacggcauggcccugugggucuuucuuuuccgaacuaagaagaagcacccugcugugauuuacauggccaaucuggccuuggcugaccuccucucugucaucugguuccccuugaagauugccuaucacauacauggcaacaacuggauuuauggggaagcucuuuguaaugugcuuauuggcuuuuucuauggcaacauguacuguuccauucucuucaugaccugccucagugugcagagguauugggucaucgugaaccccauggggcacuccaggaagaaggcaaacauugccauuggcaucucccuggcaauauggcugcugauucugcuggucaccauuccuuuguaugucgugaagcagaccaucuucauuccugcccugaacaucacgaccugucaugauguuuugccugagcagcucuuggugggagacauguucaauuacuuccucucucuggccauuggggucuuucuguucccagccuuccucacagccucugccuaugugcugaugaucagaaugcugcgaucuucugccauggaugaaaacucagagaagaaaaggaagagggccaucaaacucauugucacuguccuggccauguaccugaucugcuucacuccuaguaaccuucugcuuguggugcauuauuuucugauuaagagccagggccagagccaugucuaugcccuguacauuguagcccucugccucucuacccuuaacagcugcaucgaccccuuugucuauuacuuuguuucacaugauuucagggaucaugcaaagaacgcucuccuuugccgaaguguccgcacuguaaagcagaugcaaguaucccucaccucaaagaaacacuccaggaaauccagcucuuacucuucaaguucaaccacuguuaagaccuccuauugaguuuuccagguccucagaugggaauugcacaguaggauguggaaccuguuuaauguuaugaggacgugucuguuauuuccuaaucaaaaaggucucaccacauaccauguggaugcagcaccucucaggauugcuaggagcuccccuguuugcaugagaaaaguagucccccaaauuaacaucagugucuguuucagaaucucucuacucagaugaccccagaaacugaaccaacagaagcagacuuuucagaagauggugaagacagaaacccaguaacuugcaaaaaguagacuuggugugaagacucacuucucagcugaaauuauauauauacacauauauauauuuuacaucugggaucaugauagacuuguuagggcuucaaggcccucagagaugaucaguccaacugaacgaccuuacaaaugaggaaaccaagauaaaugagcugccagaaucagguuuccaaucaacagcagugaguugggauuggacaguagaauuucaauguccagugagugagguucuuguaccacuucaucaaaaucauggaucuuggcugggugcggugccucaugccuguaauccuagcacuuugggaggcugaggcaggcaaucacuugaggucaggaguucgagaccagccuggccaucauggcgaaaccucaucucuacuaaaaauacaaaaguuaaccagguguguggugcacguuuguaaucccaguuacucaggaggcugaggcacaagaauugaguaucacuuuaacucaggaggcagagguugcagugagccgagauugcaccacugcacuccagcuugggugauaaaauaaaauaaaauagucgugaaucuuguucaaaaugcagauuccucagauucaauaaugagagcucagacugggaacagggcccaggaaucugugugguacaaaccugcaugguguuuaugcacacagagauuugagaaccauuguucugaaugcugcuuccauuugacaaagugccgugauaauuuuugaaaagagaagcaaacaauggugucucuuuuauguucagcuuauaaugaaaucuguuuguugacuuauuaggacuuugaauuauuucuuuauuaacccucugaguuuuuguauguauuauuauuaaagaaaaaugcaaucaggauuuuaaacauguaaauacaaauuuuguauaacuuuugaugacuucagugaaauuuucagguagucugaguaauagauuguuuugccacuuagaauagcauuugccacuuaguauuuuaaaaaauaauuguuggaguauuuauugucaguuuuguucacuuguuaucuaauacaaaauuauaaagccuucagaggguuuggaccacaucucuuuggaaaauaguuugcaacauauuuaagagauacuugaugccaaaaugacuuuauacaacgauuguauuugugacuuuuaaaaauaauuauuuuauuguguaauugauuuauaaauaacaaaauuuuuuuuacaacuua

SEQ ID NO: 192450 - RNA, 19728 nt, Homo sapiens
uaccaagcaaauguucacauuuauuaauacagguuauguuuuuaagaaugaacauaaaaacagugacauacuauuuuguaaguacauuaaugauaucauauuuuaauauauacagacuaauaaacaaugacaguaaaucuucacugauuuagauaaaaugaauagucacuaaauuaauaaaaccagugcuagcuucuacuuacaauacaguuauauuacuuuuauguaaguuauucuaugguauuuggaaauaguuugcucuuuuauuuuuuuauuuuuuauuuauuuuuauuuuuugagauggagucuugcucuguugcccaggcuggagcacaguggcgcgaucucggcucacuacaagguccgccuccuggguucacgccagucuccugccucagccucccgaguagcugggacuacaggugccugccaccacgcccggcuaauuuuuuuugcauuuuuaguagagacggguuucaccguguuagccaggauggucucgaucuccugaccucgugauccacccgccucagccucccaaagugcugggauuacaggcgugagccaccgcgccuggccugcucuuuuaaauaaacauuugccuugcaacuuucuauuuuguuuaaaaugcuaccauuuuuucguaagauaagagauauguuucaaccuaauuuccaaauuacuuugugaauuccaugaagauuuucuauacuugauacuuaggagguuaaaaaaugcuuuuaaagucucauuaagucuuaaguaaauggaaauuauagaauaauuuuccuagauuucaaugucaauucuauuuucuucuguuauuucuaagcagacugacaugauugauucuuaaaagaaaaccugauuugagcaaucuauugagcaaaacauuuguaaauaaauagugcccaauuaaaucagacuuauuuuaaaaaauauauguccuguacugcauuguuuucauuaaguuauaaccacaagaaauaguaacccaaauguucaaacuucuuuagcugacaggccuuguuugugugaaacauauuuauuacacauacaucacacucuaugcaugaucuacuuugcucuugagggcaggucucugucuuauuccacucuguacacucagcaccuauuggaguggccacagcgcauaaugggugcuuccauaucagaacugacauuucagaacaacuacuagauguguuuacacccaguggaugggcauccagaaguccaugccuucuuucguuguuuuuaagauggguagagaagucuuucauggucauuaccuccuaggauaucacauucugcuuugccaguuucucauaaacaugaucaguucacagccaaucccaggaggauggagcaaauguaguggccccagucucacugcugugaggcucagcaggaagguuucuggccaaucugugucugacauggcccuggcaugugucugcugccuggaguccuccaucgggggcggacacaugcagcucucaggaauagccuacucugaaagccagccuacauucacuagaggacuuaugcucaguuuuggcuuauguguacaguguguaaaauguaaaaaauacuacccauaucaaaacagaggcuuuucaucuguuuccauaauuuuaggaauucaaacuuggauauguuuaaaauugaaaacacuagaacuucuacgcacagauaguacuaagucuuaccucuuaauaacuuaaaccuugccgucaaacaauuucaaaauacacuuauuugcaaaagugguacaagcccaaacuauggagucucucacuguugaugaacaccaugaaauguucagggcuaaacucuaccaaccuagacuuugcauauuaaaucagggaaucagagauuauuuucauaauugcuggggugcggggaaagaguguuuuaaagugccuauucuauacugcacugcaaauaauauaugugugugcauacaucuacauauacacacauguaaguauguauaugucaccuagcuauauccagaagugacauucauuuauuacuguagcauuggcaauauucccuuggaauaacaccgucaucucguccuguuaucuuucugguaauugacaaaaauacaugcuugacagcucccauaaaaagcagguaugcaagucguacaucuguuguuuuaggaggugaaucaauaaaguuuggguggggacuaauagaauccucagguuauucacuuuuauaaacuuuucuuuuuaaccucccagcagucccuuuuccuaaguuaacagcuuuuuguauaugcuguuauucagguuacuagagcagguauccauuuuacuugccaucaacugcccacugcuguuauaacugcugggaucggaacuuucuuugcagcauaagauacuguagacguaccucuggcacucagaggaagcguaauaguaaauuagggggucgaugcagcagcuuaugcugcugacacagacacagaggagguaggcaaaguaggcagccucugugguggaagugugagaaaggaaugaguaaugcgcaaucaggaggacguuuguggguccgaagcaaaugaugaagaugcagaaaacagcagcugacaggaacaaagcccgggacuucuugcugcgguuggcaacugcggaagagcuaagacaucgaaugauagacacauaacagaccguggaaaugaucagcggcacaaaaaagaagacagcagagaaggcugagaaguaguaggcauaguagccuucgagcaggguuucauugagcacaucaugacagguagugauguugagcccgggcaccuggaugguuugcuccuugaggagcagaggcacuaccccugcgauggccaaagcccagauggccagacaagugaaggaagcccuucccagaguacgccaggagagggacugcaugggauacaccacagccagaaaccggucaaugcuuaugacugucaugagcaagauagaggcguacauguuacaguaaaaugcugcagugacgaagcgacacaauucagacccaaacugccaaucacugccggaaaaguaauagcugaucuuaaaggggagcacagacacaaacagcacaucugccguggccaggugcagcauguacaccaccgccggcuucuugaccuucauuuucaggaugaacacaacgauggccaugauguuuagugggaggcugacuacaaacacuccgguguacacagaugggacaaagagugucagccaggagcuggucaaauauccggaggcaucuucugagaugaaugcaggaaguuguuuuugaagaggacugcuuuuauugauggagacuaaucuguauucaguuaacccacuuucauuuuucuccucauccucccaaaaugguucauauuuaucauugggguuccugagaagaaaugaccggggaucuaagguggcauuuguugcuuuugauucugaaaaauaaaauuaaaaaaauuuuaaauguaaaaagugaacgcaucaacaaggcaaaagcgacaagcagagagcauauuuuacuuuuguuuauguuuucuuacuaggagagugggugguaaagagcagauaaugcacaaauagacuuuauuagagaauaagccaacucaaaauacugugaaacauuugucuugauauaagcaauacuuccuaaacucugccccucaaagggacaaaggugaaugauagguuuucagagaucuacccugaagacauuaggaaaggcugaguacuugacauaaagggaucaaucauugauuuccacgcuagccacugucuauauaaacaaaucacucccagcuuccaugacuucucuuuccuccgcauaccuucaugugcacacuuucuccauuuagucugcagucaucccaugaaaccugucccuuuucaauggaaaaauccacauagaaaguugaggggauuuaggcugggcacagugggucacgucuguaaucccagcacuuugggaguccgagguggguggaucacaaggucaggaguucaagacuagccuggccaagauggugaaaccccaucucuacuaaaaacacaaaaauuagccaggugcgguggcaugcaccuguaaucccagcuacuugggagccugaggcagaagaaucgcuugaaccugggcagcagagguugcagugagccaagaucacaccacugcacuccaaccugggcgacagagugagacuccgucucaaaaaauaaaaauaaauagaaauuaaaaaaaaaaaaaaaguagaggggauuucuuuuucuuucuuuuuuuuucugagacacagucucacucuguugcccaggcuggagcacaguggcgcgaucucggcucaccgcaaccuccgccuccgggguucaaggaauucuccugccucagccucgugaguagcugggauuacaggcacgugccaccagaggggauuucuuaaagguuuuggaguuagaggcaaauuaauaaugggauucaggacucccaauucuacggccaauguccaugacaguaguuuuccucuacagucuuuaguuugcuuacacaggagaauguagaaaucucucacuauaucuggguccaaaccacaaucccugggguuaucuccuaacauagucacaagguacccaucaucucagucauucuucuacuucuuuccugagcaggucagcagagcagccgauguucuuggccacucaugccagaccaaccaagguuuuuggaguaucaaccaaaaauaggugaacacauggagguuccuggaagguagugcccaagagagggcauggaaacucugugcuccuucccacaaucgcugcccuaugcaucucuaccauguggcuguucaucuguauccucuguaauuuucuuuauaacgaauggauaaaaguaaguaaagugguucccugaguucugugaaucaugcuagcaaauuaaucgaaucugagcagggggccuuaggaacucccaauguauaguguggucagaagucuggaggcccagacuuaugacugccauuugaaguggaaggcagcguugugaaacugagcccuuaaucuguggaaucugacucuaucuccagguagauagauagugucagaauugaguuauauuagagguagauaguguccagaauugaauuauauucaaggauacccagcugguguccacuggagaaucugcaggagaauugguugcuugguauguggagaaacaagcuccagacauacggugucagaaggauugagugaagugcuggguaagagaaaacaguuuggggaaaauaguuugguuuuuccuauauaacagcagugccuauauaacauaaaaggugacuaaaacccagauagaaaauccguagucuuuuuggccuacagaaccagaggacagaguucagggcaaucacagucacuggaaaguuaggagagaauccuggaaaggaaaaagucagagagggggagcccuaaauuucaguauaacuucuguccuaggguuuggcugacccuugaacuaugcauuuguaggaaagaugagaagcaccucugcuaaagauaaaagaacugaagugauauuuaagcuucugcucaagagagaaagagucugcugcuugaguaaaaccaaauuaauuggcugcuaaagcaaaaacaccaacacucuuugaaggaauauaacaaaauccagagucuuuuuuccuguaauuuauacaagaaaaugguuuauuggacuuacaguuccacauggcuggggaggccucauaaucauagcagaagguaaggaggagcaagucacaucuuacuuggauggcagcgggcaaagagagagcuugugcagggaaacuccuguuuuuaaaaccaucugaucuugagagacccauuuuacuaucaugacaacaacacaggaaagacccgucuccaugauucaaucaucuccuacugggucccuccuacaacacaugggaauuaugggagcuacaaguugagauuuggguggggacauagagccaaaucguuaucaccagauccaaccaauauacacaaaagugauaaacucuggacgucuugucccccuucucucacacuauauacaacaaccaacuuaaauggauuaaugguuuacacauaagaccugaaacuguaaaacuacuagcagaaaacauagaggaaaagcuucaugacauugucugggcaguaauuuuuuauaaugaccauaaaagcacaggcaauaaaaggagaaguagacaacugggacuguaucaaaguaaaaagcuucugcacagcaaaggaaacaaucaacagugaagagaaaauuuaugaaaugaaagcaaauauuugcaaaccauacgucugauaaaggguuaauauccaaaauauauaaggaacuccuauaacucaacagcaagauaacaaaucaccugauuuaaaaauggacaaaggaucugaauagacauuuuucaaaagaagacauacaaauggccaacaaguauaugaaaaaaugcucaacaucacuaaucagggaaaugaacauuaaaaccacaaugaguuaucacuucauaccuguuagaauggauauuaucaaaaagaugacagauaacaaguguuggugaggauacggggaaaggaagcccaucuauacugauggugggaauuuaaauuggcauagccauuacgaaaaacaguaugaagguuccucuaaaacuaaaaauagaacuauuauauaauacagcaauuccacugcugggcauacauccaaaggaaauaaaauuaggaugcuggcugggcacgguggcucacgccuguaaucccagcacuuugggaggccaagguggguggaucaccugaggucaggaguuugagaccagccuggccaacauggcaaaacccugucucuacuaaaauuacaaaaauuagccaggcuugguagcgcauaccuauaaucccagcuccucgggaggcugaggcaggagaauugcuugaacgcaggaggcggagguugcagugagcugagauugcgccauugcacuccagccuggccgacagagcgagaccccaucucaaaaaaaaaaaaaaaaaaaaaaagaccaggaugucaauagcugcaaucucauguucauugcagaauuauuuauaauagcccaguuauggaaucaaacuagguauccacugaugaaugaaugaaugaauaaaaaauaugauguauauacacaguggaauacuauucagccuuaaaaaagaaggaaauucugucauuugcaacaacauggaugagccgagagggcauaauguuaagugaaauauggcaggcaccgaaagacaaauauagcaugauuucacuuauauguggaaucgaaaacaguugaacucauggaagcagagaagagaauggugguuaguagaggcugggguuggauggguggguaggguagacuggggagacauuggucaaaggguacaaaauuucuguuaaaaggaauuaguuagaaaaaucucuuguauaauacggugacuauaguuaauaacaauguguuguauacuugacaauugcuaagagaguagacuuuaaguggucucaccacaaaaaaugauaaguauuugagguaauacauguuauaaguuugauuuagccaucucacaaguuaugcauauuucaaaacauuauguuauacacuauaaauauauauaauuuuuugucaaauaaaagaaaaagggggcugccaggugugguggcucacaccuguaaucucaacacuuugggaagcccaggugggaggacaaguugagccugggagaucgaggcuacagugagguaucaucacaccauuguacuccagccugggcaacagagugagacucugucucuaaaaaaaaaaaaaaaaaagugacccagucuuaaguaaaaagacagugagcggaaaccaaccucaaguugacccagauguuggaauuagcagauaaggauuuugaagaauguauuacaaccaugugcaaaaaaaaaaaaaaagaaaaauauuuuauagaaaugaacugaaaauaggaaauaucagcaaagaacuaccaaguggaaauucuagaaauagaaaauaaaauacaauauguuggcaucuauuuccaaaaugaagagcaaagcuagaguaguaccaacucagagacagcagagcagagccugguaguguaggguugaggucaagcuaccuaagcaaaguugggagagggucuccagacaaugaagggguggccuggcaggagaucugucacagggaaggaaugaaugucuccagugaugaaugugaauacacacuugugucuacauugauccuuaaggguaagaacuguuccuguuaaucucugaaccuccaguacccugugcccugcaugugguaggcacauauuuguauucuaauauugacucuguucagggaucacuuaacuucucugaauuaagcucagaaucauuaaaauggaauucuaauuccugucuggccuacaaaucuggcaacuggagcaucccgugugaaacaggacauacauucacuuuggaaaccauaacgauuaagcaguuuaagaaauuacuauuauccuuccucucccacuuccauguagugugcuuuuauacccaauuguuugcucacuuaauuaaguuaaaaggaaaucuagguucaucuucccuccuacuuagcaauguuuauaguuuuuuaguacaaugagggaaugaacaaguuguauauuauauagcucuaggguucagagcuauaaaucaaauuuugaauucacaaucuuuucuggaaguaucacucucuuaccuuugcaaugcauguaacuuacucuguguucaccuugccccagucacacagaagccugaccuugguaccaacagacccuguggaugugaggcuguucucaagaucacaaugagugugugggugcugaaagaaaagaaugaauggcuucuggcacuuaaacauuuuuuuuuauuuuuaauuuuuuuuguuugugguucuggcacuuuaauaucacaaaaacaugcauaugcaaaaaugcugaucuagaggaaccaauuuuuuuuugagauggagucuugcucugucacccaagcuggagagcaguggugcgauuuuggcucacugcaaccucugccuccccaguucaagcaauccuccugccucagccucccaaguagcugggauuacaagcacgcaccgccaugcccagcuaauuuuuuuuuuuuuuugagacagagucucgcucuuucgcccaggccggacugcaguggcgcuaucucuaucucggcucacugcuaacuccaccucccggguucacgccauucucuugccucagccucccuaguagcugggacuacaggugccugccaccgcgcccggcuaauuuuuuguauuuuuagaagaaaugggguuucaccguguuagccaggauggucucuaucuucugaccucgugauccacccaccucggccucccaaagugcuaggauuacaggugugagccaccgcgcccggcugcccagcuaauuuuuguauuuuuaguagagaugggguuucaccaugcuugccagcuagucucaugcuccuggccucaagugauccacccaccucagccucccaaagugcugggauuacaggcauaagccacugcaccuggccaaggaaccuuaaaauaaugcaauucuccucugcaguuuuggaagccuggccagauuaugggcuuuugugaugcacagaggggaaaaaguggacaugaacaugcauacuuacauacaugaaucaagaugacaccugagagacugacacaaugugaaaacuaauaaauacaacuaagcucuucagauacuaucacuuagucugaaaauaaaacugucacuagacuuuacucuguauuuaguacuuaggcaguaaguacuuguuuuaaaaaacaucuucucuggguaggccucaggcagacgguacuuccgacaggaacauuauacuuguggaaacaugaaauuuuuauaggcuagagcucaggaagaauguauaaucccuugguuaaauaucgcugccuaagguguuaccuuuucuugauacuauggguuugauauucugguuuuugugaaauuaaagaaugucggaaaaaaaaagaaaagaaaaaauguaguauauaccagcaucaaagaaaggacaaaaccaaugcaaggugacuagacaauuccaacuagcucaagacccuuaggcugaaauuugaguuuaaguaucucgcuuuuccuccaguccuagcacaacucaggucaaggagaaagugcuugugaaggugcccaaaucucuuaucauucaucucuguuuuuuuuuuugguuaagcuaugguuucacaaaaaaggcagcagagguccugaauucaguucucauacgauuugcuaaguuucacuuaauuuaggcucuucuaaauugcucuagaguaguuuuguuaucgaauacagcaaauuauuaaauaguuuaaauacggacucuuuaacuguggcgauuuuuaaaaauuagugaguuaggcaacacguuuucugacugugaugagaucuguccuggaagcagaggggugacuagaggaucucugaaugucgcauuugauccugggauuuauaccacaccagcauuccaugacacacaugguuuugacucacaguucugcccuucggggcucaugcuuuuucagaguuaacaaagcagaagucccaggacuuugcucacauucccacacagagcacaagaguugaaacaacacuacaggcuaaagagaaaugaagaggaggacaggaaaauaacagaaucacacuaacucugucaaguggaaaacaccagcauuacuggaauguuuuacucccucagauucaaacaaacaccauuuuccaaugaaaagaacuggggcuucuuaaagaaaugacuaguuccagaucugggguaggaaauacacaagaugaacauugaacaucuucaaagaauaucaggguuaggucaaaaagacgcuggagucaaucucaaagggcucccacugaccaaagaugugacauguugaucaccaauuugaccaucaaaagaauaaugauggaaaugaauugaaacauuucauacauguuaagauccaugaguugaagacgcagucagccagauccaguauguagaaaagacagauggcuuaguuucuuugacaaauaagaacuaagacagauggcuuaguuucuuugacaaauaaauagcaauaaaaaaggggugggggggcaguuacagauuaaaauguaaugguggaccuuguuugaaccugauucaaacaaaccaacuguuaaaagguauuuaugagacaauaagguaaauaugaacacugacugauuaucagaugauauuaaggaauuguuaggccgggcacgguggcucacgccuguaaugccagcacuucgggaagccgaggcaggaggacugauugaacccaggaguuccagaccagccugggcaaugcagcaaaauccuaugucuauuaaaauaaauacaaaaauuagcuggucgugguggugugugccuguagucccagcuacuuuggagucugaggcaggaggauugcuugagcccaggagguugagacuguggaugagccaugauugugcuacugaacuccagccuuagcaacagaguaagaaugugucucaaaacaaacaaacaaacaaaaaaacagaaggaaauguucauuuuuuagguauuauaauuguauugugguuauguggaaaaaagaguucuaaucucuaaggaugcuuacugauguuuuuaugaaugacauaauaugauaucugggauuugcuuuaaaauuauacaguugggagaggaggaaacuugaggguuuagauaaaacaagauuggugacauguaaauaauguugaagcuggaugauggguauggggaguaacuauacuguucauuuuuggguauguuugaaaaaucccauaauaaaaguuaaaaaaacaaacaaauacuguaugcauguuuauuugccacuagaaguuaagggcaaggguuuuugcuuuuuucuuuuguccuaguucugaaggggaaaauguucuugcaugcuugugugaagauugucuuauauuuagauaauuuauuugguaucaacucuucaaaagcuuuucuggaauauggaagcauugguguaugaaaaaaccuuaccaucuuuuugagcaccuacuaugugccagauacuucacuugccuuaguucauauaauucuaacauuucuaugacaugagcauuauaacuaccauuuuauaaaugacaacauggaggcacagagaggcuaaguaacuaauccaaagucacacagcuaugaaguagaggagccaggguuugaaccuaggucugcccagcuccaaaggucauaccuuuugaccacuccacgcuauucucuccuuaaaaacuugugauucaugaccuacuucuaaaagaguaccaucuuuuucucuuugcaugucaccaaacaaaugaaucugcccauccuuuuagcuacaguaggcaguauguggacaugugaauggcuagcuuaacgugaugaugcccaaagcuugggaauucuggaguccuacugacuuuggcugcacaccaaccacacaugccaacaacuugguccuuacacacaggagagagauagcagggagauauucaaggacaaaacagaaaaauacaucuuuaaaacacuguucuagauggagcagaugcaagagcaguaagugaacaaaaaucucugcuacagaaaaagcagaauuaaagacaaaauucuuuuuuuuuuuuuugauacagagucucacucugucucccaggcuggagugcaguggcacgaucuuggcuugcugcaaccucugccuccuggguucaagagauucuccugccucagccuccugaguagcugggaugacaguugugcaccaccaugcccggcuaauuuuuguauuuuuaguagagacaggguuucaccauguuggccaagcuggucuccaacuccugaccuuaagugaucugcgccucagccucccaaagugcugggauuacaggcaugagccaccgugcccaaccuaaagguagaauucuugacugacugggguucagaagaagcugccaauaucagaggccuccucuccucccauuccauguccuggagcagguacuccucuggaagcauaggaaagcaagccuaagaggaagcugggagaagggaaguugcaggaaaguaaacgcagguguacccaacgccacagcaggcaugaagacuacauaaggaaagugugugggcucuugcuuggagcagccuggaggccagagccugacguggggugaggaugcuagcaggccuugcccgggaacuacucagguuccccggcuuuccccauuucuccaggucuguucuccaagaaaaguuacagguccugagcucucugucuugggaaugcugaucucuacucuccaacaagacaucuagcuaaaaugaaaacuaauucacagucaaggaugucaaugaucaccaauuccuccccagggcuggggauggggacagcuuuguauuguacaaaauacugugaguuguacuauaaaaacuguccccaugcccaacccugcccaaguccuucugcagucuguauaucugaacucaaauaaauuagguucuagacaugauaagaacaauaauaaacaacaguuccaggaaaacagaacucuuccugaaaagcuaauaaggccuuugauuuggcuaccauaggaauauucauguagcugcugcaauauguuuuaaauuauguuauagauuuagcaauggcuaugaaaucaauucacaagauugcaauaagcauuaaaaauagaauauaguguggaaaauaucaaaaugcauacaaugcaguaaaggugagcacuguuuguggaaaauaucaaaaugcauacaaugcaguaaaggugagcacuguuugguaaaacuuuuguuucauguuuacauauauacuaugauuguccacacauauuuauugaaaacacacaucccuaccauaucagaaugugaaguguuguuucuacaguucuuacuguugguuacgaaagaggaaaauacuguacugguaaacacuauucuacaauaccauaauaccugauuuuuaauucaucauagacuugaaauauaaauagauuacauaaugucuuuuccuaaaguuauauaaauguguuuucaagggcaaauugcagauuacuccuguuguuucaaaaggccacuuacuuuugaaagcaaauaauguauauaggaccgucagggcccuuuaaguggcuuccuccaaguaccacgacaaggucagugugggagacgguaucuggggaagugaaagcucaugcccagaaaaaaauucucaguauauagacagagcuauuuaugacgacaguuuuaggcacaagcaagagaaagaaaaaggcagaaugaaagaaaucgcaaaaaaggaaacaaacagaaaauuaugaaugguaaaacuauggaguccucaacacuaguaucauagucaaaaauaaaccaaggcccugaguccuaauaacucuucuaacaaggauguuuuugugaguauccgcaauggaaggggagccuaggugcucacgaaaacuaguuaaagacugggcaugguggcucacgccuagaauuccagcacuuugggaggccaagguagguggaucgcuugaucccaggaguuugagaacagccugggcagugugauaaaaucucgucucuacuaaaaauacaaaaauuagccaggcgugguggcaggugccuguagcccagcuacucuggaggcugaguuaggaggauagcuugagccugggaggcagagguugcagugagccaaauuugugccucugcacuccagccugaguaagacaccuagacccugucucaaaaaaacagcaacaacaacuuuaacccaccuaaaguuaaguuccccagacacuaagaccacauauuauaugauucuauugauaugaaauaucaaaaauagguaaauccauagagaaaaaaggcaaacuggugguuccuggggguaggggaagggagaaugggaucugacugcuuacugguuuccuuucggggaaaugacaggauuuuggaaguagguagggguuuacaguguacauuguacacuguaaauguacuaaauaccaaugaauuguauacuuuaaaaugguuaauuuuauguuaugugaauucuaccucaauuuuauuauuuuauuuuuuaaauuuaaaugauuaauuuaaauuuaaaauuuucauuuauuaaauauuuugaagacagcgucucucccacucuguugcccaggcuggaguguagucacgugaccauggcucacugccaccuugaacuccugggucaggccauccucccagucucccaagugcugggacuacaggugcacaccacagugccuggcuacuuuuuaauuauuuuuuuuaauagagauggggucuuacuauguugccuaggcuggucucaagcgaucaucuggccuaggguucccaaagugcugggauuacaggugugagccacugcacccagacccugagaaccugcuaugcugguauguucuauaaaaauaaaggcaaagccacuaaaaauuauuagauauagauagauagauagauaguagggcagaaaauuacuugcugacucauaagaaaucugacuuucaggcuuuauagagcuuucuggucugcuuacgguagaaccacugcucaguuuucugucuuucuguuuagguuuacuagcaauaucucuuguaacaucugauuaauuaguguauucaugagcagggaucuuuucagagccugccuuaucaucuguuagcgaaaguaaaugagagaauaccacaguccgugcauaaaugcucacuaaauaccucccugugcugggccugagcuaccaaggcgauagggcacagacuuugcuucuauauuuugaugaauuaucaaaaauagguaaauccauacuguacuagggagcacagugggguuacuucucuacuguaagaggugcugggagucuagauggcuuccuuucuauaggggguguuagagaaagccugcacuucggagagacaggccuguggucaacucccaauuccaccucuuuuuuuuuuugagagagagucucacucuguugcucagacuggagugcaguggcacaaucucaguucccugcaaccucugccuuccagguucaggcaauucuggugccucagccucccaaguagcugugacuacaggugugcaccaccauacccagcuaauuuuguauuuuuaguagagacaggguuucaccauguuggucaggcuggucucaaacuccuggccucaagugaucccccugcuuuggccucccaaagugcugggauuacaggcaugagccaccgcacccagucccaauuccaccucuuucucaacuugugacuuaaccauucugggucucuguuuuauaaccaguaaaaugaggaugacaucuacucaaagggcuguugugagaaauaaauaagauaguauuguaacgucccuaagaaggaugucagcuguagucaguacuccacagaggguagcuguuuuuaauuaaacaugaacguggcggguaugggauauggggagggcauucuggccagagggaguggcaugcggacagaagccagagaaagcauagcuccuugaagggaggaucuagaggauggggcugggugaacuggagggugaguaauaggagauggcuggagaggggcuggggacccuccugcaaggggaggagcacuucauuccaugccagagaauugggcuugacucugugaguaggaggguagcaaguggaauugcccaccaaguucucucugucauagucaccaccagcuauucuugaacacuuuaacccucuagagccccauaaaauuuauaaacaucaccuuuuacucuuggauguuggcccuuuuaaugaucacauaucaucucacuuaaauugucuagacgaauguaaacugguugaugaauuuacacauuucucaacaacuaucugcugagugaacauuuguuuuagucaccauggggauaaauaaaacuuuauaaucuuaguugggagaaugagacacacacacaaagugacaaggcaggaaaugccaaaaugagugggaacaaaaagucgggaagugcuggaggaaggcucagcuugguggucagggccagcccugggagggcuucaccgccccucuuggcacacagagcugguaauccuggacaauaaacucuaucacagcgguggcgguucaaggaugggaggcacuguuggaugccucagagucccagcaccacuaccuuaugacagacaaugcuuagaauugucaaugcauggugguaauagaaaguaaaccuaucuuggguugauuuuauuagugauuuuaaauuuucuaaagacaaagccccacuuauuccuaauugcuugcacccaggguggguggacugccccuucccugccccacccgccaccacuugcuuagccgcugucucugggucuuaguugcagaaucagcaaaaggggauaaauacccaccuuaacaagguguuuugacaaggugaaaugagacaauccaagugaaaauuccuucuggcccagggcuugacauggaauauggcacuuagcaagcgcuccuuuuccucuaucauacuccuuucuucuuucccucccaaagugguuccagaauccaguguugauaaacuagccaaguucauccaccugccuuucugucuacaccagcacuguccauauuaacaugcaccacuccugccaugaggauguaagaagcuuggcagaaaccaguacgcuuugacuucacucccuaaugaggcuacacaccuugcugggaggccacugugagaaagggugcagcauuucuauaagcucuguucuccaccccaugauccaaaucucaaacaaaacacuggauucucaagagcguguccucaaacuacauugugcaaauuacauaaugguaugugaaaucauaucucaucgcaaacaauuuuucaggaguucucgguguucucucaaacacuuucggcaacaaugcucacuuaucugcaggcaggcuaguuacugcuaaacacugggccccagucuggagcucuuaguuuucccaaaagcaucucaaaacucacccugaacaaagacagagaggcgagaacaugcuaugucuuugucaccucuuaaucuugaugugucuacacuuuuuuuugagugugggagcaauauagagugcacauucuuuuagcgauaacaagaaaacccgcuagaacuucuuucagcguaaaaaaaauggcucaaagcuuauaaaauacuauuguuauuaggaaauucaaaaacacuuuucucacuuucuaauuagcgccuuuacaggcuaaaaacaacucaucugugcugcucuuggggaaagggauacagaaaauauuugaccaaauaaauuaaucaaauuuauuuauuuggucaaguggccagauacuuaaaaauagacuacuaguggggaaaauauucuaggggagcaaccuucuugcaguggaucagaaaucucguuaagaaauacugggaucccacaguguucgagggagcccgguccuggggagggaucucucucuucaacucacuuagaaggaauggguucuagguaacaacaaaauccucuccauguccccucccccgccaccacgcggagccucugcuauugucaccauauaucucgcacccugcgcaccuccuggacacaaggccgggccgggggcugcugguacugauucucugcuaaacaugccaagggacugccugggcuuuucucuacaucacuuuucucgccuguaaaaugugcaagaaaaaaacuuccaacaaagcaaaacuucagcggcagcgguucgccacuuuauauuuuaaagaucgaaacguuuauugguggagcaacgugagagcuuuucuuuuugggggugguccugggagaaacacaaugacaagugcaacgcaggacugcaggcucccccagggggcuuccgcuccauccuccuccauauccaacaccccguggcaggcgggcugcacccuccaagaucgaguccaaaggggcaucggcugggcccgcgaaggggguggcacgccccaccuaaacgugacuggaaaaaacuccagaucucagcccaaaugccaguuuggcuuucggaggaaacugaggcaggggugaggagaaggcgcaacagugacccccgcagucuccccucggcgucccuccgcccgcgcaccccauucccgugcaucucucaccuggccugcgggcccgggugcgggcagacaacagcgggccgcacagacugaagcaggcggccaccagcagcagccgccgcggccccauugucccgggcucugcgcggcgcugcuccgggaggcugccccgccucgggcugcuccgcuucacccucucuccugacuucugcgggucggggagccggucuucgcggcaggcagagcgcagggugcccacggguaagaucaggguccaagcgacccucggcgagcgcugugucuggggcgguuagcggggcggggcgggacuggggcgcgcggucgcgcgggcgcgagcgaggaagggcgcccuccggcgugcagugagagucucu

SEQ ID NO: 192451 - RNA, 19728 nt, Homo sapiens
agagacucucacugcacgccggagggcgcccuuccucgcucgcgcccgcgcgaccgcgcgccccagucccgccccgccccgcuaaccgccccagacacagcgcucgccgagggucgcuuggacccugaucuuacccgugggcacccugcgcucugccugccgcgaagaccggcuccccgacccgcagaagucaggagagagggugaagcggagcagcccgaggcggggcagccucccggagcagcgccgcgcagagcccgggacaauggggccgcggcggcugcugcugguggccgccugcuucagucugugcggcccgcuguugucugcccgcacccgggcccgcaggccaggugagagaugcacgggaauggggugcgcgggcggagggacgccgaggggagacugcgggggucacuguugcgccuucuccucaccccugccucaguuuccuccgaaagccaaacuggcauuugggcugagaucuggaguuuuuuccagucacguuuagguggggcgugccacccccuucgcgggcccagccgaugccccuuuggacucgaucuuggagggugcagcccgccugccacgggguguuggauauggaggaggauggagcggaagcccccugggggagccugcaguccugcguugcacuugucauuguguuucucccaggaccacccccaaaaagaaaagcucucacguugcuccaccaauaaacguuucgaucuuuaaaauauaaaguggcgaaccgcugccgcugaaguuuugcuuuguuggaaguuuuuuucuugcacauuuuacaggcgagaaaagugauguagagaaaagcccaggcagucccuuggcauguuuagcagagaaucaguaccagcagcccccggcccggccuuguguccaggaggugcgcagggugcgagauauauggugacaauagcagaggcuccgcgugguggcgggggaggggacauggagaggauuuuguuguuaccuagaacccauuccuucuaagugaguugaagagagagaucccuccccaggaccgggcucccucgaacacugugggaucccaguauuucuuaacgagauuucugauccacugcaagaagguugcuccccuagaauauuuuccccacuaguagucuauuuuuaaguaucuggccacuugaccaaauaaauaaauuugauuaauuuauuuggucaaauauuuucuguaucccuuuccccaagagcagcacagaugaguuguuuuuagccuguaaaggcgcuaauuagaaagugagaaaaguguuuuugaauuuccuaauaacaauaguauuuuauaagcuuugagccauuuuuuuuacgcugaaagaaguucuagcggguuuucuuguuaucgcuaaaagaaugugcacucuauauugcucccacacucaaaaaaaaguguagacacaucaagauuaagaggugacaaagacauagcauguucucgccucucugucuuuguucagggugaguuuugagaugcuuuugggaaaacuaagagcuccagacuggggcccaguguuuagcaguaacuagccugccugcagauaagugagcauuguugccgaaaguguuugagagaacaccgagaacuccugaaaaauuguuugcgaugagauaugauuucacauaccauuauguaauuugcacaauguaguuugaggacacgcucuugagaauccaguguuuuguuugagauuuggaucaugggguggagaacagagcuuauagaaaugcugcacccuuucucacaguggccucccagcaagguguguagccucauuagggagugaagucaaagcguacugguuucugccaagcuucuuacauccucauggcaggaguggugcauguuaauauggacagugcugguguagacagaaaggcagguggaugaacuuggcuaguuuaucaacacuggauucuggaaccacuuugggagggaaagaagaaaggaguaugauagaggaaaaggagcgcuugcuaagugccauauuccaugucaagcccugggccagaaggaauuuucacuuggauugucucauuucaccuugucaaaacaccuuguuaagguggguauuuauccccuuuugcugauucugcaacuaagacccagagacagcggcuaagcaagugguggcggguggggcagggaaggggcaguccacccacccugggugcaagcaauuaggaauaaguggggcuuugucuuuagaaaauuuaaaaucacuaauaaaaucaacccaagauagguuuacuuucuauuaccaccaugcauugacaauucuaagcauugucugucauaagguaguggugcugggacucugaggcauccaacagugccucccauccuugaaccgccaccgcugugauagaguuuauuguccaggauuaccagcucugugugccaagaggggcggugaagcccucccagggcuggcccugaccaccaagcugagccuuccuccagcacuucccgacuuuuuguucccacucauuuuggcauuuccugccuugucacuuugugugugugucucauucucccaacuaagauuauaaaguuuuauuuauccccauggugacuaaaacaaauguucacucagcagauaguuguugagaaauguguaaauucaucaaccaguuuacauucgucuagacaauuuaagugagaugauaugugaucauuaaaagggccaacauccaagaguaaaaggugauguuuauaaauuuuauggggcucuagaggguuaaaguguucaagaauagcugguggugacuaugacagagagaacuuggugggcaauuccacuugcuacccuccuacucacagagucaagcccaauucucuggcauggaaugaagugcuccuccccuugcaggaggguccccagccccucuccagccaucuccuauuacucacccuccaguucacccagccccauccucuagauccucccuucaaggagcuaugcuuucucuggcuucuguccgcaugccacucccucuggccagaaugcccuccccauaucccauacccgccacguucauguuuaauuaaaaacagcuacccucuguggaguacugacuacagcugacauccuucuuagggacguuacaauacuaucuuauuuauuucucacaacagcccuuugaguagaugucauccucauuuuacugguuauaaaacagagacccagaaugguuaagucacaaguugagaaagagguggaauugggacugggugcgguggcucaugccuguaaucccagcacuuugggaggccaaagcagggggaucacuugaggccaggaguuugagaccagccugaccaacauggugaaacccugucucuacuaaaaauacaaaauuagcuggguaugguggugcacaccuguagucacagcuacuugggaggcugaggcaccagaauugccugaaccuggaaggcagagguugcagggaacugagauugugccacugcacuccagucugagcaacagagugagacucucucucaaaaaaaaaaagagguggaauugggaguugaccacaggccugucucuccgaagugcaggcuuucucuaacacccccuauagaaaggaagccaucuagacucccagcaccucuuacaguagagaaguaaccccacugugcucccuaguacaguauggauuuaccuauuuuugauaauucaucaaaauauagaagcaaagucugugcccuaucgccuugguagcucaggcccagcacagggagguauuuagugagcauuuaugcacggacugugguauucucucauuuacuuucgcuaacagaugauaaggcaggcucugaaaagaucccugcucaugaauacacuaauuaaucagauguuacaagagauauugcuaguaaaccuaaacagaaagacagaaaacugagcagugguucuaccguaagcagaccagaaagcucuauaaagccugaaagucagauuucuuaugagucagcaaguaauuuucugcccuacuaucuaucuaucuaucuauaucuaauaauuuuuaguggcuuugccuuuauuuuuauagaacauaccagcauagcagguucucagggucugggugcaguggcucacaccuguaaucccagcacuuugggaacccuaggccagaugaucgcuugagaccagccuaggcaacauaguaagaccccaucucuauuaaaaaaaauaauuaaaaaguagccaggcacuguggugugcaccuguagucccagcacuugggagacugggaggauggccugacccaggaguucaagguggcagugagccauggucacgugacuacacuccagccugggcaacagagugggagagacgcugucuucaaaauauuuaauaaaugaaaauuuuaaauuuaaauuaaucauuuaaauuuaaaaaauaaaauaauaaaauugagguagaauucacauaacauaaaauuaaccauuuuaaaguauacaauucauugguauuuaguacauuuacaguguacaauguacacuguaaaccccuaccuacuuccaaaauccugucauuuccccgaaaggaaaccaguaagcagucagaucccauucucccuuccccuacccccaggaaccaccaguuugccuuuuuucucuauggauuuaccuauuuuugauauuucauaucaauagaaucauauaauauguggucuuagugucuggggaacuuaacuuuagguggguuaaaguuguuguugcuguuuuuuugagacagggucuaggugucuuacucaggcuggagugcagaggcacaaauuuggcucacugcaaccucugccucccaggcucaagcuauccuccuaacucagccuccagaguagcugggcuacaggcaccugccaccacgccuggcuaauuuuuguauuuuuaguagagacgagauuuuaucacacugcccaggcuguucucaaacuccugggaucaagcgauccaccuaccuuggccucccaaagugcuggaauucuaggcgugagccaccaugcccagucuuuaacuaguuuucgugagcaccuaggcuccccuuccauugcggauacucacaaaaacauccuuguuagaagaguuauuaggacucagggccuugguuuauuuuugacuaugauacuaguguugaggacuccauaguuuuaccauucauaauuuucuguuuguuuccuuuuuugcgauuucuuucauucugccuuuuucuuucucuugcuugugccuaaaacugucgucauaaauagcucugucuauauacugagaauuuuuuucugggcaugagcuuucacuuccccagauaccgucucccacacugaccuugucgugguacuuggaggaagccacuuaaagggcccugacgguccuauauacauuauuugcuuucaaaaguaaguggccuuuugaaacaacaggaguaaucugcaauuugcccuugaaaacacauuuauauaacuuuaggaaaagacauuauguaaucuauuuauauuucaagucuaugaugaauuaaaaaucagguauuaugguauuguagaauaguguuuaccaguacaguauuuuccucuuucguaaccaacaguaagaacuguagaaacaacacuucacauucugauaugguagggauguguguuuucaauaaauauguguggacaaucauaguauauauguaaacaugaaacaaaaguuuuaccaaacagugcucaccuuuacugcauuguaugcauuuugauauuuuccacaaacagugcucaccuuuacugcauuguaugcauuuugauauuuuccacacuauauucuauuuuuaaugcuuauugcaaucuugugaauugauuucauagccauugcuaaaucuauaacauaauuuaaaacauauugcagcagcuacaugaauauuccuaugguagccaaaucaaaggccuuauuagcuuuucaggaagaguucuguuuuccuggaacuguuguuuauuauuguucuuaucaugucuagaaccuaauuuauuugaguucagauauacagacugcagaaggacuugggcaggguugggcauggggacaguuuuuauaguacaacucacaguauuuuguacaauacaaagcuguccccauccccagcccuggggaggaauuggugaucauugacauccuugacugugaauuaguuuucauuuuagcuagaugucuuguuggagaguagagaucagcauucccaagacagagagcucaggaccuguaacuuuucuuggagaacagaccuggagaaauggggaaagccggggaaccugaguaguucccgggcaaggccugcuagcauccucaccccacgucaggcucuggccuccaggcugcuccaagcaagagcccacacacuuuccuuauguagucuucaugccugcuguggcguuggguacaccugcguuuacuuuccugcaacuucccuucucccagcuuccucuuaggcuugcuuuccuaugcuuccagaggaguaccugcuccaggacauggaaugggaggagaggaggccucugauauuggcagcuucuucugaaccccagucagucaagaauucuaccuuuagguugggcacgguggcucaugccuguaaucccagcacuuugggaggcugaggcgcagaucacuuaaggucaggaguuggagaccagcuuggccaacauggugaaacccugucucuacuaaaaauacaaaaauuagccgggcaugguggugcacaacugucaucccagcuacucaggaggcugaggcaggagaaucucuugaacccaggaggcagagguugcagcaagccaagaucgugccacugcacuccagccugggagacagagugagacucuguaucaaaaaaaaaaaaaagaauuuugucuuuaauucugcuuuuucuguagcagagauuuuuguucacuuacugcucuugcaucugcuccaucuagaacaguguuuuaaagauguauuuuucuguuuuguccuugaauaucucccugcuaucucucuccuguguguaaggaccaaguuguuggcaugugugguuggugugcagccaaagucaguaggacuccagaauucccaagcuuugggcaucaucacguuaagcuagccauucacauguccacauacugccuacuguagcuaaaaggaugggcagauucauuuguuuggugacaugcaaagagaaaaagaugguacucuuuuagaaguaggucaugaaucacaaguuuuuaaggagagaauagcguggaguggucaaaagguaugaccuuuggagcugggcagaccuagguucaaacccuggcuccucuacuucauagcugugugacuuuggauuaguuacuuagccucucugugccuccauguugucauuuauaaaaugguaguuauaaugcucaugucauagaaauguuagaauuauaugaacuaaggcaagugaaguaucuggcacauaguaggugcucaaaaagaugguaagguuuuuucauacaccaaugcuuccauauuccagaaaagcuuuugaagaguugauaccaaauaaauuaucuaaauauaagacaaucuucacacaagcaugcaagaacauuuuccccuucagaacuaggacaaaagaaaaaagcaaaaacccuugcccuuaacuucuaguggcaaauaaacaugcauacaguauuuguuuguuuuuuuaacuuuuauuaugggauuuuucaaacauacccaaaaaugaacaguauaguuacuccccauacccaucauccagcuucaacauuauuuacaugucaccaaucuuguuuuaucuaaacccucaaguuuccuccucucccaacuguauaauuuuaaagcaaaucccagauaucauauuaugucauucauaaaaacaucaguaagcauccuuagagauuagaacucuuuuuuccacauaaccacaauacaauuauaauaccuaaaaaaugaacauuuccuucuguuuuuuuguuuguuuguuuguuuugagacacauucuuacucuguugcuaaggcuggaguucaguagcacaaucauggcucauccacagucucaaccuccugggcucaagcaauccuccugccucagacuccaaaguagcugggacuacaggcacacaccaccacgaccagcuaauuuuuguauuuauuuuaauagacauaggauuuugcugcauugcccaggcuggucuggaacuccuggguucaaucaguccuccugccucggcuucccgaagugcuggcauuacaggcgugagccaccgugcccggccuaacaauuccuuaauaucaucugauaaucagucaguguucauauuuaccuuauugucucauaaauaccuuuuaacaguugguuuguuugaaucagguucaaacaagguccaccauuacauuuuaaucuguaacugcccccccaccccuuuuuuauugcuauuuauuugucaaagaaacuaagccaucugucuuaguucuuauuugucaaagaaacuaagccaucugucuuuucuacauacuggaucuggcugacugcgucuucaacucauggaucuuaacauguaugaaauguuucaauucauuuccaucauuauucuuuugauggucaaauuggugaucaacaugucacaucuuuggucagugggagcccuuugagauugacuccagcgucuuuuugaccuaacccugauauucuuugaagauguucaauguucaucuuguguauuuccuaccccagaucuggaacuagucauuucuuuaagaagccccaguucuuuucauuggaaaaugguguuuguuugaaucugagggaguaaaacauuccaguaaugcugguguuuuccacuugacagaguuagugugauucuguuauuuuccuguccuccucuucauuucucuuuagccuguaguguuguuucaacucuugugcucugugugggaaugugagcaaaguccugggacuucugcuuuguuaacucugaaaaagcaugagccccgaagggcagaacugugagucaaaaccaugugugucauggaaugcuggugugguauaaaucccaggaucaaaugcgacauucagagauccucuagucaccccucugcuuccaggacagaucucaucacagucagaaaacguguugccuaacucacuaauuuuuaaaaaucgccacaguuaaagaguccguauuuaaacuauuuaauaauuugcuguauucgauaacaaaacuacucuagagcaauuuagaagagccuaaauuaagugaaacuuagcaaaucguaugagaacugaauucaggaccucugcugccuuuuuugugaaaccauagcuuaaccaaaaaaaaaaacagagaugaaugauaagagauuugggcaccuucacaagcacuuucuccuugaccugaguugugcuaggacuggaggaaaagcgagauacuuaaacucaaauuucagccuaagggucuugagcuaguuggaauugucuagucaccuugcauugguuuuguccuuucuuugaugcugguauauacuacauuuuuucuuuucuuuuuuuuuccgacauucuuuaauuucacaaaaaccagaauaucaaacccauaguaucaagaaaagguaacaccuuaggcagcgauauuuaaccaagggauuauacauucuuccugagcucuagccuauaaaaauuucauguuuccacaaguauaauguuccugucggaaguaccgucugccugaggccuacccagagaagauguuuuuuaaaacaaguacuuacugccuaaguacuaaauacagaguaaagucuagugacaguuuuauuuucagacuaagugauaguaucugaagagcuuaguuguauuuauuaguuuucacauugugucagucucucaggugucaucuugauucauguauguaaguaugcauguucauguccacuuuuuccccucugugcaucacaaaagcccauaaucuggccaggcuuccaaaacugcagaggagaauugcauuauuuuaagguuccuuggccaggugcaguggcuuaugccuguaaucccagcacuuugggaggcugagguggguggaucacuugaggccaggagcaugagacuagcuggcaagcauggugaaaccccaucucuacuaaaaauacaaaaauuagcugggcagccgggcgcgguggcucacaccuguaauccuagcacuuugggaggccgagguggguggaucacgaggucagaagauagagaccauccuggcuaacacggugaaaccccauuucuucuaaaaauacaaaaaauuagccgggcgcgguggcaggcaccuguagucccagcuacuagggaggcugaggcaagagaauggcgugaacccgggagguggaguuagcagugagccgagauagagauagcgccacugcaguccggccugggcgaaagagcgagacucugucucaaaaaaaaaaaaaaauuagcugggcauggcggugcgugcuuguaaucccagcuacuugggaggcugaggcaggaggauugcuugaacuggggaggcagagguugcagugagccaaaaucgcaccacugcucuccagcuugggugacagagcaagacuccaucucaaaaaaaaauugguuccucuagaucagcauuuuugcauaugcauguuuuugugauauuaaagugccagaaccacaaacaaaaaaaauuaaaaauaaaaaaaaauguuuaagugccagaagccauucauucuuuucuuucagcacccacacacucauugugaucuugagaacagccucacauccacagggucuguugguaccaaggucaggcuucugugugacuggggcaaggugaacacagaguaaguuacaugcauugcaaagguaagagagugauacuuccagaaaagauugugaauucaaaauuugauuuauagcucugaacccuagagcuauauaauauacaacuuguucauucccucauuguacuaaaaaacuauaaacauugcuaaguaggagggaagaugaaccuagauuuccuuuuaacuuaauuaagugagcaaacaauuggguauaaaagcacacuacauggaagugggagaggaaggauaauaguaauuucuuaaacugcuuaaucguuaugguuuccaaagugaauguauguccuguuucacacgggaugcuccaguugccagauuuguaggccagacaggaauuagaauuccauuuuaaugauucugagcuuaauucagagaaguuaagugaucccugaacagagucaauauuagaauacaaauaugugccuaccacaugcagggcacaggguacuggagguucagagauuaacaggaacaguucuuacccuuaaggaucaauguagacacaaguguguauucacauucaucacuggagacauucauuccuucccugugacagaucuccugccaggccaccccuucauugucuggagacccucucccaacuuugcuuagguagcuugaccucaacccuacacuaccaggcucugcucugcugucucugaguugguacuacucuagcuuugcucuucauuuuggaaauagaugccaacauauuguauuuuauuuucuauuucuagaauuuccacuugguaguucuuugcugauauuuccuauuuucaguucauuucuauaaaauauuuuucuuuuuuuuuuuuuuugcacaugguuguaauacauucuucaaaauccuuaucugcuaauuccaacaucugggucaacuugagguugguuuccgcucacugucuuuuuacuuaagacugggucacuuuuuuuuuuuuuuuuuuagagacagagucucacucuguugcccaggcuggaguacaauggugugaugauaccucacuguagccucgaucucccaggcucaacuuguccucccaccugggcuucccaaaguguugagauuacaggugugagccaccacaccuggcagcccccuuuuucuuuuauuugacaaaaaauuauauauauuuauaguguauaacauaauguuuugaaauaugcauaacuugugagauggcuaaaucaaacuuauaacauguauuaccucaaauacuuaucauuuuuuguggugagaccacuuaaagucuacucucuuagcaauugucaaguauacaacacauuguuauuaacuauagucaccguauuauacaagagauuuuucuaacuaauuccuuuuaacagaaauuuuguacccuuugaccaaugucuccccagucuacccuacccacccauccaaccccagccucuacuaaccaccauucucuucucugcuuccaugaguucaacuguuuucgauuccacauauaagugaaaucaugcuauauuugucuuucggugccugccauauuucacuuaacauuaugcccucucggcucauccauguuguugcaaaugacagaauuuccuucuuuuuuaaggcugaauaguauuccacuguguauauacaucauauuuuuuauucauucauucauucaucaguggauaccuaguuugauuccauaacugggcuauuauaaauaauucugcaaugaacaugagauugcagcuauugacauccuggucuuuuuuuuuuuuuuuuuuuuuuugagauggggucucgcucugucggccaggcuggagugcaauggcgcaaucucagcucacugcaaccuccgccuccugcguucaagcaauucuccugccucagccucccgaggagcugggauuauagguaugcgcuaccaagccuggcuaauuuuuguaauuuuaguagagacaggguuuugccauguuggccaggcuggucucaaacuccugaccucaggugauccacccaccuuggccucccaaagugcugggauuacaggcgugagccaccgugcccagccagcauccuaauuuuauuuccuuuggauguaugcccagcaguggaauugcuguauuauauaauaguucuauuuuuaguuuuagaggaaccuucauacuguuuuucguaauggcuaugccaauuuaaauucccaccaucaguauagaugggcuuccuuuccccguauccucaccaacacuuguuaucugucaucuuuuugauaauauccauucuaacagguaugaagugauaacucauugugguuuuaauguucauuucccugauuagugauguugagcauuuuuucauauacuuguuggccauuuguaugucuucuuuugaaaaaugucuauucagauccuuuguccauuuuuaaaucaggugauuuguuaucuugcuguugaguuauaggaguuccuuauauauuuuggauauuaacccuuuaucagacguaugguuugcaaauauuugcuuucauuucauaaauuuucucuucacuguugauuguuuccuuugcugugcagaagcuuuuuacuuugauacagucccaguugucuacuucuccuuuuauugccugugcuuuuauggucauuauaaaaaauuacugcccagacaaugucaugaagcuuuuccucuauguuuucugcuaguaguuuuacaguuucaggucuuauguguaaaccauuaauccauuuaaguugguuguuguauauagugugagagaagggggacaagacguccagaguuuaucacuuuuguguauauugguuggaucuggugauaacgauuuggcucuauguccccacccaaaucucaacuuguagcucccauaauucccauguguuguaggagggacccaguaggagaugauugaaucauggagacgggucuuuccuguguuguugucaugauaguaaaaugggucucucaagaucagaugguuuuaaaaacaggaguuucccugcacaagcucucucuuugcccgcugccauccaaguaagaugugacuugcuccuccuuaccuucugcuaugauuaugaggccuccccagccauguggaacuguaaguccaauaaaccauuuucuuguauaaauuacaggaaaaaagacucuggauuuuguuauauuccuucaaagaguguugguguuuuugcuuuagcagccaauuaauuugguuuuacucaagcagcagacucuuucucucuugagcagaagcuuaaauaucacuucaguucuuuuaucuuuagcagaggugcuucucaucuuuccuacaaaugcauaguucaagggucagccaaacccuaggacagaaguuauacugaaauuuagggcucccccucucugacuuuuuccuuuccaggauucucuccuaacuuuccagugacugugauugcccugaacucuguccucugguucuguaggccaaaaagacuacggauuuucuaucuggguuuuagucaccuuuuauguuauauaggcacugcuguuauauaggaaaaaccaaacuauuuuccccaaacuguuuucucuuacccagcacuucacucaauccuucugacaccguaugucuggagcuuguuucuccacauaccaagcaaccaauucuccugcagauucuccaguggacaccagcuggguauccuugaauauaauucaauucuggacacuaucuaccucuaauauaacucaauucugacacuaucuaucuaccuggagauagagucagauuccacagauuaagggcucaguuucacaacgcugccuuccacuucaaauggcagucauaagucugggccuccagacuucugaccacacuauacauugggaguuccuaaggcccccugcucagauucgauuaauuugcuagcaugauucacagaacucagggaaccacuuuacuuacuuuuauccauucguuauaaagaaaauuacagaggauacagaugaacagccacaugguagagaugcauagggcagcgauugugggaaggagcacagaguuuccaugcccucucuugggcacuaccuuccaggaaccuccauguguucaccuauuuuugguugauacuccaaaaaccuugguuggucuggcaugaguggccaagaacaucggcugcucugcugaccugcucaggaaagaaguagaagaaugacugagaugauggguaccuugugacuauguuaggagauaaccccagggauugugguuuggacccagauauagugagagauuucuacauucuccuguguaagcaaacuaaagacuguagaggaaaacuacugucauggacauuggccguagaauugggaguccugaaucccauuauuaauuugccucuaacuccaaaaccuuuaagaaauccccucugguggcacgugccuguaaucccagcuacucacgaggcugaggcaggagaauuccuugaaccccggaggcggagguugcggugagccgagaucgcgccacugugcuccagccugggcaacagagugagacugugucucagaaaaaaaaagaaagaaaaagaaauccccucuacuuuuuuuuuuuuuuuaauuucuauuuauuuuuauuuuuugagacggagucucacucugucgcccagguuggagugcaguggugugaucuuggcucacugcaaccucugcugcccagguucaagcgauucuucugccucaggcucccaaguagcugggauuacaggugcaugccaccgcaccuggcuaauuuuuguguuuuuaguagagaugggguuucaccaucuuggccaggcuagucuugaacuccugaccuugugauccacccaccucggacucccaaagugcugggauuacagacgugacccacugugcccagccuaaauccccucaacuuucuauguggauuuuuccauugaaaagggacagguuucaugggaugacugcagacuaaauggagaaagugugcacaugaagguaugcggaggaaagagaagucauggaagcugggagugauuuguuuauauagacaguggcuagcguggaaaucaaugauugaucccuuuaugucaaguacucagccuuuccuaaugucuucaggguagaucucugaaaaccuaucauucaccuuugucccuuugaggggcagaguuuaggaaguauugcuuauaucaagacaaauguuucacaguauuuugaguuggcuuauucucuaauaaagucuauuugugcauuaucugcucuuuaccacccacucuccuaguaagaaaacauaaacaaaaguaaaauaugcucucugcuugucgcuuuugccuuguugaugcguucacuuuuuacauuuaaaauuuuuuuaauuuuauuuuucagaaucaaaagcaacaaaugccaccuuagauccccggucauuucuucucaggaaccccaaugauaaauaugaaccauuuugggaggaugaggagaaaaaugaaaguggguuaacugaauacagauuagucuccaucaauaaaagcaguccucuucaaaaacaacuuccugcauucaucucagaagaugccuccggauauuugaccagcuccuggcugacacucuuugucccaucuguguacaccggaguguuuguagucagccucccacuaaacaucauggccaucguuguguucauccugaaaaugaaggucaagaagccggcggugguguacaugcugcaccuggccacggcagaugugcuguuugugucugugcuccccuuuaagaucagcuauuacuuuuccggcagugauuggcaguuugggucugaauugugucgcuucgucacugcagcauuuuacuguaacauguacgccucuaucuugcucaugacagucauaagcauugaccgguuucuggcugugguguaucccaugcagucccucuccuggcguacucugggaagggcuuccuucacuugucuggccaucugggcuuuggccaucgcagggguagugccucugcuccucaaggagcaaaccauccaggugcccgggcucaacaucacuaccugucaugaugugcucaaugaaacccugcucgaaggcuacuaugccuacuacuucucagccuucucugcugucuucuuuuuugugccgcugaucauuuccacggucuguuaugugucuaucauucgaugucuuagcucuuccgcaguugccaaccgcagcaagaagucccgggcuuuguuccugucagcugcuguuuucugcaucuucaucauuugcuucggacccacaaacguccuccugauugcgcauuacucauuccuuucucacacuuccaccacagaggcugccuacuuugccuaccuccucugugucugugucagcagcauaagcugcugcaucgacccccuaauuuacuauuacgcuuccucugagugccagagguacgucuacaguaucuuaugcugcaaagaaaguuccgaucccagcaguuauaacagcagugggcaguugauggcaaguaaaauggauaccugcucuaguaaccugaauaacagcauauacaaaaagcuguuaacuuaggaaaagggacugcugggagguuaaaaagaaaaguuuauaaaagugaauaaccugaggauucuauuaguccccacccaaacuuuauugauucaccuccuaaaacaacagauguacgacuugcauaccugcuuuuuaugggagcugucaagcauguauuuuugucaauuaccagaaagauaacaggacgagaugacgguguuauuccaagggaauauugccaaugcuacaguaauaaaugaaugucacuucuggauauagcuaggugacauauacauacuuacauguguguauauguagauguaugcacacacauauauuauuugcagugcaguauagaauaggcacuuuaaaacacucuuuccccgcaccccagcaauuaugaaaauaaucucugauucccugauuuaauaugcaaagucuagguugguagaguuuagcccugaacauuucaugguguucaucaacagugagagacuccauaguuugggcuuguaccacuuuugcaaauaaguguauuuugaaauuguuugacggcaagguuuaaguuauuaagagguaagacuuaguacuaucugugcguagaaguucuaguguuuucaauuuuaaacauauccaaguuugaauuccuaaaauuauggaaacagaugaaaagccucuguuuugauauggguaguauuuuuuacauuuuacacacuguacacauaagccaaaacugagcauaaguccucuagugaauguaggcuggcuuucagaguaggcuauuccugagagcugcauguguccgcccccgauggaggacuccaggcagcagacacaugccagggccaugucagacacagauuggccagaaaccuuccugcugagccucacagcagugagacuggggccacuacauuugcuccauccuccugggauuggcugugaacugaucauguuuaugagaaacuggcaaagcagaaugugauauccuaggagguaaugaccaugaaagacuucucuacccaucuuaaaaacaacgaaagaaggcauggacuucuggaugcccauccacuggguguaaacacaucuaguaguuguucugaaaugucaguucugauauggaagcacccauuaugcgcuguggccacuccaauaggugcugaguguacagaguggaauaagacagagaccugcccucaagagcaaaguagaucaugcauagagugugauguauguguaauaaauauguuucacacaaacaaggccugucagcuaaagaaguuugaacauuuggguuacuauuucuugugguuauaacuuaaugaaaacaaugcaguacaggacauauauuuuuuaaaauaagucugauuuaauugggcacuauuuauuuacaaauguuuugcucaauagauugcucaaaucagguuuucuuuuaagaaucaaucaugucagucugcuuagaaauaacagaagaaaauagaauugacauugaaaucuaggaaaauuauucuauaauuuccauuuacuuaagacuuaaugagacuuuaaaagcauuuuuuaaccuccuaaguaucaaguauagaaaaucuucauggaauucacaaaguaauuuggaaauuagguugaaacauaucucuuaucuuacgaaaaaaugguagcauuuuaaacaaaauagaaaguugcaaggcaaauguuuauuuaaaagagcaggccaggcgcgguggcucacgccuguaaucccagcacuuugggaggcugaggcggguggaucacgaggucaggagaucgagaccauccuggcuaacacggugaaacccgucucuacuaaaaaugcaaaaaaaauuagccgggcgugguggcaggcaccuguagucccagcuacucgggaggcugaggcaggagacuggcgugaacccaggaggcggaccuuguagugagccgagaucgcgccacugugcuccagccugggcaacagagcaagacuccaucucaaaaaauaaaaauaaauaaaaaauaaaaaaauaaaagagcaaacuauuuccaaauaccauagaauaacuuacauaaaaguaauauaacuguauuguaaguagaagcuagcacugguuuuauuaauuuagugacuauucauuuuaucuaaaucagugaagauuuacugucauuguuuauuagucuguauauauuaaaauaugauaucauuaauguacuuacaaaauaguaugucacuguuuuuauguucauucuuaaaaacauaaccuguauuaauaaaugugaacauuugcuuggua

SEQ ID NO: 192452 - RNA, 140879 nt, Homo sapiens
aaacgaagcccacccaccgacugacaaggccccaaggggacaagcgauccccgcgcgggauacucacccguuaccucaggaucgcgacuacaacucccaggaggcugcgcgagcgacggaccaacgcccuucccagaaugcagcacagcugcaucccuaccccgcccucuccuuucuccgcuccuccugcuuuucuacccgucgucacccgggagagccggagguaggguucgggaggaggaucccgaaggcucggcgugucgcgucagacgccgggagggggacggggcggggaguagugggggagaaugggaggacgaaggggaggggaaaggacaggggaggggaggguaaauagugggccaggcaggaagauggcggcgguagcggaggugugaguggacgcgggacucagcggccggauuuucucuucccuucuuuucccuuuuccuucccuauuugaaauuggcaucgagggggcuaaguucggguggcagcgccgggcgcaacgcaggggucacggcgacggcggcggcggcugacggcuggaaggguaggcuuccuucaccgcucguccuccuuccucgcuccgcucggugucaggcgcggcggcggcgcggcgggcggacuucgucccuccuccugcucccccccacaccggagcgggcacucuucgcuucgccaucccccgacccuucaccccgaggacugggcgccuccuccggcgcagcugagggagcgggggccggucuccugcucgguugucgagccuccaugucggauaaucagagcuggaacucgucgggcucggaggaggauccagagacggagucugggccgccuguggagcgcugcgggguccucaguaaggugagcaaccccuggugccaagggaccccuggccagacucaccugcagcgaggcaauccgcugaggcggugggguggggcuggcgggaggcgcggaacgugccggggugcgaggcugaguguugcugcagcgacuagggaugaggcggggauauaggggcacuguccuuguugcccgggggcucgucgggggcagccgaggaccagggaaaggguguauaaaccugagauccaguuugggaggccagaugcgcgccgugacuugggacuuagggcggcagcugucccggguguaaggaauccggguugggcuucagcgguguccgaacgacugggcaugggagcgguucaagucggaccucuuaaaagagguuggucucucugaggaugccaagccgaguagguuggggggcacugcggacgcaacucuuucgacagaagcuggagcgacucagcuugguguugaaauuugagguguugaauucugcuagguuagauguagugagacagaugaauguggaggacuuucucccucacccuguaccuuaguucagaauagagauauugaaucggcacaugauggguacaggaaauauucauaguaacuuggaacaugugagaauggagacugaucuuuaguccaggaagagcauuacuuaauaauaaaauauuuuugcgguaaggggucgaggguaaggaaaagauguuuuaucuuuuauauauuuuuuaaaaucccuguaucaaaauuuuagcaaagcagucauuauaggacugcagguggaugaucucuugauauuacauaguuguggggauuuuuuuuuuaaguuuuugcuguaagaagauucacguagccuuuuugacuucucucucccuuccuguuaaacuuuuuuagacauggcuggagcuagcaguuaacuuggagagggggagcugggccagucccucaacaagcuggucauaagauacuaugucaugugcagccaguggcuauuaagaaaucacccuguuuccaguauucauauuuggcaaaucacuuggacauuauuuguggaauuguuucauauuaggcuuuuauaaugucuagaaagcuaaugagaagggggccaggaaaggcaugaguagucagaacuaaggauugcaaguguugacuuuuauuuguauagcagcaaaauuauguuguauauugaugcugugaucauucuugaaauuucagugcaagguuuucaguaacgagaagcuccucaggauuucuuuagauuaaauguauccuguaauuuaggaaucucuauugaacacauuguguaguagguauacauuuucaguugguaauaggaaguggguuacuugcuucucagugauuuugguaguuucaucacugcucauaagaugggaagcugacugccauauuaguauugugauguguuaaguauuuuacgaaacaaauuguacuuuugaccuacugauaauuacuuuuuuggggguugggggaguggagugaccgggggaaaaaguaaccagugcucuggaguagguauacuauagauaaaaaaauggaagaccaaucucgauauuuaaaugcauacaaauguauuugaucaccucuauggaaggugaauagcuuaaauuuugacuguugcugcauauguagaaugaauaggaauaaagcuuuugguauucuugcucaaagcuaugaaggaaauuuuccugagauuuaccaauuuaugguuauauacaguuuucuggaagcuuuuuaaucaaggguauucuaaauugaguauauauacucauacugaguaugguagauguuuuuaaauguaaauuauauaguuugaauucuuuguauucaccugguaauuuaaacaaaggucagaacucggauuuuguucuuuuccuuccauugaguaauguaaauaagucccgguacaauucauuuuguuucucccccaaaaugggguggauuuggaaugggcuuggguaaauuuauauuagaaauauaccaguucaaaggguauuuuccauaugguaaucugaaauacauggaaauaccuaugaagcauauuucuuauaaaucacuuaaguguauagauuccaaaaauacuagauagacaauaauucuaucuaguuauagcaaguaucgugauggaucaugguggggaaaagaugcaugccuuaguaggacuugagagcaccuaagccuggauaaaauaaucucauucaauuucugaauuuccuccauccuucaugguuuaccuucuguuuuuccacacaccaaacuguuugaaauucuguccauccuuaagaguccaagccaaauacuguccuuuccauaaagccuuuucuuauuuugccaucauucaagaccuccuucacuugaauucccauagcauuuuguuuguagcuugcuucugacucuuauucuaaauauauauuuuuuucucuugaguuugugucugcuggccuguuggccacaguaauauuugauuccccugcagugucuagcauauugccuuaucuguauuuguuaaauggggaagagugagggaacauuaugagagcagagaaaagacaaaaaacuugucuuccaggugucaugauacagcuaauacuuacugaguaaaggguccugaagcugauacaguuuguucagucucuuauaagaacuaauauuaaguuauggauacauaauugcuggggcuucuccucuaacauugaaagaguucuauucuagugagaaaugcugaagguuaagcuucauuagcuauguauaacucuuccucagauucagaaaauacuauguccaggcacuguucuaagucuauucuuguuuaaacuuaacucuaagagaauuugacaaagaaaaaaagaacacaaagagaauaaguaacuugaccacugucacaaaguuuagccuuaugaagugugguaauuguaaaugagguaggauuaauccaugaagggucuugaaugcccuaaacaauuuguaugacagucagugggaaguuguccauguaaguuuuggagcuagagacucaauacgaucaauguaagaaaaguaggcaaauaugcuuaguaaguaaauaagcuuguguaaauuaugaaaaaaacagaagauacuagagaaaaaauuauuaagucuccuaaggaauacaggaacuggauaauuugauuggaauaguugaaaaugagaagaggaggcaaauuuaaggguuuacuaugaaggaaagaugagcagcuuuugguaaugggcuauaaauauugagaaggaacacuuagguauugaguaucuucugugacuaugcuaggcauuuucauuauuuuauucggccgucagucaacaggcaaagaaacugaaguuuacaaaaguaacuugucaaaacucucuucacaugaguuauaaaauaguugagccuauuuuauccuauauccacuaaucuguuuguauaucuaauacacuaacucugagcagaaguagcagucuccccaaggaaguaggaaaauaggaaggaaguauacuuuauaggaaggugaauucaguuuuauugguaacuaucauuuauuucaagcccgugucuaaguggugguacaucucaagcaguuagaaauaaggaaauggugauugggagccacuagaaugaguuaaauguuggcuugggugaguucucagagagugguuguaaugauggggcuuagaaaaauuaagaacuggcuagggaugguggcucaccuguagucccagcacuuugggagaccaaggaagacagaucgcuugagcccaggaguuugagacgagccuuggcaccauagcgaaaccucauuucuacaaaaaauuagccagaugugggggugcacaccuguagucucaaucacuugggaggcugaggugggaggauugagcccaggagauugcgguaaacugagauggugccacugcacuccauccugggugacagagcgagacccugucucaagaaaauacuaaauaaaagaaaauuuaagaagugaaucaaucucaaaaaugcuuaauuagagaacagaaaaauaaaagauuucucaguggauauagagccugagccaaugcaguauauuuuggcaauccauuuuuaauuaguuuuuggaauuggcagauaguuuuugagauuuuucuauacuuaacaccccagagcauagauaaaaacaugcaaaaauaaguauuccuguaaagguuacauuucugccuuuuccaguuuauugugaucuucacuuugcagcaagacuuuagcaacacagaaacucuuaagguauugaagacaauccaauauguuuuugaaaagcaauuuuauuuuuguuuuauuacucuugaguuugaaaaaugcauguucagaggaacuuggaaaauguauuggccauuuuuaauauuauucaguucuguagaggaaaaguuaaaguugaugccagcuuacuaaagauuauuauuuuuauuuugauauaguuacagcuguuauaaauuuucauauaggaauaacaacaaaaguagaguuuagcaauaauugacuuuauacuuccguugauuuagaaggcuucaugcagucuuuggugucagaaugagagacuacauacauaacugaacauacuucucuguugaauauguuaauuaugacaaggaccaaaacaaauaucaugaagguacuuaggagaggaugaaagcauacgaagaauaaacaauaauuuuaaccaaaaucuggcuuucguuuuauucuucaaauguuagaagaaaauguuauauuuuauuucuuacagauuuauuuauaauauuguaaaaauuacugaaaaucauuaugcaaucuagaaaaucucaacuuuucacuuuuuguaaucauuuuacuguuuaugcuuagaauuaaguuggacuuuucacguuuugguuuuaaaauuagauugcuguuucacaaaguuuggauuucuaaaauacuucuauuuuuuguuuucuucucucuucccuuccccuucccacucccaguggacaaacuacauucauggguggcaggaucguuggguaguuuugaaaaauaaugcucugaguuacuacaaaucugaagaugaaacagaguauggcugcagaggauccaucugucuuagcaaggcugucaucacaguaaguuccuuuucuucuucauucaacaaauauuuauugagugucagcuacauaccaggaacuguucuacguguucaggauacauccguggauaagauaaagauccuuguccuuguagaauauacauucuaauacuuuuuuccauaaagugauuuuacugugguuuuuacuacauauuguuauuuugcauagacauguaguuuuuaucugguggguauaucaaaccaguuuaagggcuucaggaaaaaaaaauguuugaagccuuuuuauuuguugaggcugggacaguuacuuuguagguuacugaauauuuaaaaauaauacaucuuguaaguaacauucuaaaauuuuaacuuaaaaauauaaauguaaauucauuuuuaaacuuuuuaacauugagcuaaugccaucucuuuguggaguugggagaagcuguucucauguuccucacacaugauuugcuauuuacaguuuugauuucucuaauguggaauaaaagccugaagauaacuuuugaaaaacucuaaguauaggcuccuucuaacuuuuuaugauuuccccuuauauuuugcaguuacaucacuuuucuccaauucaacacccuuuaaaagaauaacucaccuucguugagucauucuacuuaguuuacauuuuguuguucuuuuuuuguuuuuuuguuuuguuuuguuuuguuuuugagacagucuugcucugucacccaggcuggagugcaguucuguggucucagcucacugcaaccucgaccucccagguucaagcaauucuucugcuucagccucccaaguagcugggacuauagccacgugccaucacgcccggcuaauuuuuguauuuuuaguagaaaugggguuucacuguguuggccaggcuggucucaaacuccugaccucaagugauccacccaccucagccucccaaagugcugggauuacaggcaugagccaccgcgccuggccuacuuaguuuacauuuaacuuaguauauagaaacaacuguuccuuuuugcacucguagucauuagacaugaauaauguuuaagauauguaagaacuauaacaaguaaacuggcauaaacagguuugggaacaaccaacugacuuguuaagcauguaacccaacuagugagaacagaaguaccugauaauacaaaaaauagcauacugguuaagaauggucagcaugccaugggccaaaaaaaaaaaaaaaaaaguguuggcuaaggccagacaguuaaauagaggucaguuaagggagcuguuguaguuaaaaucugaaaauggguacguuaaaacaaaaauacagaguuuacuaacucacucaaagagaagucacauuuugugauagaauuuauuuggcuuauaaaagugaaagauauauauauaauacuucagauuuccguuaauaucuaauccuuacuuagcguauguuuguuaugcauuuagggaaaaucuuacaguauuuuuacauuauuuuuuauacauuauuuccccccuuguauauucaaaguuugaaaacaaaaguuuagaauugaauaucaaguuagagaaacacagaagaaauauuuggaaguguugauaaugaaacuacgcucucuauucuuagagacaauuuuuaggaaauagcuuuaacauaaaggcucaguauuuauuuugacugguaugugguacauuguaauguguuuagaaauuguaucuaguuuaauauuuuggguguuuuucuuccgagauagaucauuauucauaucaauggacagaauaguggauugaaauguaccuugcgaucuugaaguguuuuuccuugauccuccacuccccuucuuuugcguauuauuauuggauguuuauuaguugcaaugcuuaacucuuugaaaauaguauaaugauugauguaaaaauggggaggaauuaaauuuuaucuuuauuauucucuaaguaguaguauuccuagaguaccaugcuaguuucuguggauuuaaauauaguuauucugucuugaauuauggacuauaauaauguugccuggcuuauuuggagaaaagaaaauuuuaaauuaaacauuuaauuuaaauguuuaauuuaaauuaaacaaaaaauuuaaauguuuaauuuaaauuaaacaaaaaauuuaaauuuuaacauuuauauccaucuucucaggaagaaaacaguguuacuuuauuguaauugauuuuuguuauagcuauauguacaugcauaacuuucauugugguacauaguaaaagacaugcguaggaacaagaaacaauuugaauucuuugaaggagagauaaaaguagaaguaaaaagaugaauuaggcaacaaaaucugugugguagucuuagauacaaugaaauggaugauaggaaaaaacacaagcauuuauauuauugaacuugaacuuuccuugcccuuuggguucacagacuccauguuacauauuuaaaggaaauuaaaaauauaacugaauucagugaacucaggaugaguuuacaaauuagaguauguacuuuaguuaaauaaauaaauguaauaguaauauuccucauuaaauuuuaauaggcaucucuugguauuuuuuuuccuuaaauaugggcuaugccuauugucacuucaugucagaauacaaagaauguaaauguuuaauuucuuuauauggcacucuuaugaaauugauaauauucacguacaaagaaaucugggcuugaagaguugaugugacuuuacuguaaccauucauuacuauauuauuuguugguggaccuagcaucugaacccacauuucuugauagagccuaauccauuuuaaguucauucuuaguuuaaugauuaaaucacucuuaauuuauaaaaacaauauucuuuaucugugugauaauaaagugggugaaauaauuucaaggaagaaaguaugucuugagagaauuuauuccuuaaugugaaaggauugacaguaaguaggugagaggaaaaauaguauucccuuacuuuguguaaaaagagcuauuuguauguagaauaaguguuuguagaaagacaguugaauucuucaguuauuauagcuugauacuuagaagacccagccccugcuacaaaauuugccgcauaguagauauucugaauauguuaguuguaauuguuucaauuaaaagcaaauguuuauggaauauuuacacuguuuacuuuuuauauucuauuuuuaaaauaaagugcacaugauaaaaaauauaauuuguggcauuaaaaaguuuaagaaguacaugcugcuuuuuagucuugcacuugagggacaaccaaacuuaaauuucuggucauccuuucagaaaauauguaggacuauacaaggauuuguuuauaucuuucauaaauauuuacacaaaugguaucauauuaagccuauuguucugcaccuuguuuuaauacaacuuacacauuaacuguuauauucuguugaaucguguggauauauuauauuuauuugccuggacccuguuuuugcacauuuaaaucaugccuaauuuuuauuacaaucauuauugaaacaaauauguacuuuaaaauuuguuuuuaguuauugucaaauacuccuucaagaguaccacuccucacuccuaccaguagugaaugagugccucuguuucuccuuacccgcaaguauugaggaaguuggguuuggcaaauguuaaaguauuugucaaacugcuacauuaaaaugguaucuuauuauuuuaaauugcacuuuuuauccaugagguugaguaacuuaauaauuuauagcccauuuuuauuucuuuuuccuuuuccaauugcuuaugcacuuuuuuuuugguuuuucuuuccuuuuuggcuuguagaaacucuucauaugguaauuaaccauuuggcacauuuguugcaaauauuuucccccacauugucacuugucuguuucuucuuugcuuguuuuauagucuauauuaggcccuagagaaaucuuagauuuuuacauacucuuauugacaucuuuuauuacggcuucuguauuuacuuguuuagauagguguuucucucucaaagacuaucucucuauaugaauguagauauauuuucaucuaaaauuuacacuugaauuuugauuccuguggaaguuauuuuaguuuaaggagugauauugauguuuuuaguuuuuuuuccacaugacuaauuauguauccugguagcauuaauuaaauaacuaaccuuuuuccaagugguuucaaacaccacuuucaucauauauuacggucccauauuuauuuaagguuguuucuggacucucuucugggcauuuggcuuguccuucuuauccucuguuuaaaauuauauuguggguauuucaucaaccaguuccuuaaacugcuaaugauucauuggugaagauagaaguaauuuauuugcaguuacuaaaguuaaaacagguagagauuuuugguauaauaucuucagauagaauuaguuuuccuaaguucuguaguuucaugucucaccuuaggcaucugccuuuguauaccucauaucuuguugaacuuuuaaaaucaccagaugaguagaauuccuauuauucuuaucauagguugguuuuagggaaauuugccaguuuuauguuuuaauauuuuuggaaggaaaacugaaagguaaugaaaauguuacuguuggauuaaaaaacaaauuaaguccaaauagugauuaggcaaguuggugagguaggggguugcugcaagagcggaaguugaaagaucuuggaaaaauuaaagaaacuucauagaaccccaucucuacaucaaaaaaauacacaaaucagcuuggcguggugguacacaucuguagucucagcuucuuuggaggcugaggugggaggaucaccugcuucagccucgcagguggagccaaggugaugccauugcccuccaggcugggagacagagugagacccugucucaaaaaaaaaaaacaaaaaaaacagacaauggagauauaaaagcaagggaaggaaguguucaaaauugaagagaaccacaaaaauaaacauaaauuuugaaagugccaaauaguagucagauguaaaaaauuuuugaauguggaauuguaaaaugagaaauuacauuauggaaaugaacuucagcaaauuggguaucaucaaagaugauuagugccauaaauagucauuauaagaacuccaaauuagcgagaaauccaagaagaaggccuuuucucaagugugcaguuuuucuauguugaacaguauuagugagaacuaaaggaaagagaggaagguaugcagcaaauaaaagcacuagauaagaaacuaguuguuaauucucauuggaggagcauuugucagugaauuuuuaaagaaaugagacucuucgaucugcuaagauuuaugcuuugagaaacucauaauuuaucuguuuagcaguucauuagaaaagaauauauuccaucuuucaauaacaugauucagauaauguaacucaaauagcgugaaguagaaaguacuuaaaauauuugguaagaggccuuggaagaagaaaaacaugaaaaagggcaccuguugaaaucuggguuucagaauguggaaauaacuuacagaaaauuauauaauuuuaauuauauaauuauacaauguauucauuugcuaggguugccauaagaaaguaccacaaacugggugacuuaaacaacagaaauguauuguuucacaguuccagaggcuggaaauaggaucaaggugugggcaggguugguuccuucuguuggcggugagggagaagcuguuucaugaguuuccccuuacaucugguguuugcuggcaaucuuugguacuccauggcuuguggaugcaucacuccaaucucugucugcauguacacauggcauucuuuuuauguauuugucuuuuuccagauuuccccuauuuaucaggacaccagucauacuggauuagggguccaaccuacuccacuguuaucucauucuaacuaauuaaauccacaaugcugcuguuuucaaacaagguaacauucagagguacugggagauaagccuugaacauauaauaugauuuugaggggggcacaguucaacccguaacacaaaguaucuguuaagccaagagccccagucugauugccaucuguuauuuuaugacgucacugggcuuaagaaaauuguauauguggugcauuuuauuuuguguagggguuguaggaacaugacuguuaaauauuuauaaagcaacucuuaauuccgaagugcuuaaaacguugugcaugggccgugaagucaaaucuggguucagaccuuaacuguguguauuaguccauucucauacugcugugaagaaauaccugagacuggguaauuuauaaagaaaagagauuuaauugacucacaguucugcauggcuggggaggccucaggaaacuuacaaucauggcagaaggcacuucuucccagggcggcaggagagagaaugcaaaccaggcaaagggggacaagcucuuuauaaaaccaucacucccaugauucaauuaccucauaacaggucccucccacaacacauggggauuaugggaacuacaauucaagaugagauuuggguggggacacagccaaacuguaucauucugccccuggccccucccaaaucucauguccucacauuucaaaacacagucaugccuuuucaacagucccccaaagucuuagcucauuccaguauuaacccaaaaguccaaauccaaagucucaucugagacaaggcaaguccccuccaccugugaaccugugaaaucaaaagcaaguuaguuccuucuuagauacauugaggguaugggcaguggguaaauacaccuauuccaaaugggagaaauuggcaggcagccaaaucuuaaagguccaaaaugaucuccuuugacuccaugucucacauucaggucacucuuaugcaagaggugggcucccaccaccuugggcagcuccgucccuguggcuuugcagaguacaagccccccuccuggcugcuuucacaggcuagcauugagugucuacagcuuuuccaggugcacagugcaagcugugaguggaucuacuauucugggaucuggaggacaguggcccucuucucacagcucuacuagguacugcccagugaggauugugggggugggggggcuucaaccccacauuucccuucuguacugcccuagcagagguucuccaugagggcuccccuccugccgcaaacuaaugccuggacauccagguguuuccauacauccucugaaauguaggcggaguuucccaaaccucaguucuugacuucuuugcacccacuggcccaacaccgugggaaagccgccaaggcuuggggcugacacccucugaagcaauggccugaacuguccucagaguggccuugaccccuuuuagccacagcuggagcugaagcagcugagacacagggcgccaggucccaagacugcacaaagcagcaaggcccugggcccagcccaggaaacccauuuuucccuccuaggccuccagguguuugaugggaggggcugccaugaaggucucggacaugcccuggagacauuuuccccauugucuuggugauaacauuuagcuccuuguuacuuaugcaaauuuuugcaguaggcuugaauuucuccccagaaaauacguucuucuuuucugucacaucaacaggcugcagauuuuccaaacuuuuaugcucugcuucaucuugaaugcuuugccaccuagaaauuucuuccuagaaauuuaagaccuuaaaucaugucuuucaaguucaaaguuccauagaucucuagggcaggggcaaaaugccgccagucucuuugcuaaagcauaacaagagucaccuuugcuccaguucccaacaaguucugcaucuccaucugaggccaccucacccuggacuucauuguccauaucauuaucagcauuuuggucaaagcuauucaacaagucucuaggaaguuccaaacuuucccacauuuuccugucuucuucugaaccuccaaacuguuccagccucugccuguuacccaauuccagaguugcuuccacauuuucggguauccuuauagcagcaccccacucucuacgguaccacuuuacuguauuagucuguucucaugcuccuaugaagaaauacccgagacuggguauuucuuuuuauaaagaaaagaguuuuaauugacucacaguucugcuuggcuggggagguucaggaaacuuaaaaucauggcggaagucaccucuuaacagggcggcaggaaaaagaaugagagccaagcaaagggugggaaagcccuuauaaaaccaucgcccccaugauucaauuaccucccaccagguccuuuccacagcacauggggauuaugggaacuccaauucaaaaugagauuuggauggggaugcagccaaaccauaucacugcuuacagccaaagguaccuuuggcagauuacuaaauuucucugagcuuucagcuuccuuaacugauuaaacaagggggauaaugucuaaguauggaaugauuauguaauuaaaagaaauaacauauaaaaguacuugguacaauucuuggcacauaguaguagucucucaaauuuauuuugugaaauguuuauguugggaguaaagccuacaguuaaaaaauuaaagaacagaaguugucagacccuuuuaucaaagggggacaaagaugcaguugacucacuagagccgggauacguagcgugucauguuugaacagauucucaugcaacucuguucagaaauuuucuuccaccaaauaguucuauuuaccaaccuaaaaaaauaguuaacucuuuauauguuuucuguguauucuugauagucuuuuuuucuuugaucuauuuauuguuuccuaccuuuuuuugguuuuccuuauucuaugucuuuuuuuaaaaaaaagauauguugugccuuuuaaaaaaucacauugagauauaauuuacacacggucaaauucacccuuuuaaaguauacaguuauaguuuucacaaaugcauacagucauauagucauuaccacaugaguauauaaaauauuuccauccucccagauaguucucuucugccccauuguagucaguuacccucuguguccccaaccucugguaaccacuguugcagcauauuauauacauggaaucaugcaguaugcaucucuuugugucuggcuuuuaacuuaccauaaugcuuuuacuacucaucauguuguuacauguauucuuaacuuguugcuuuuuauugcugaauacuguuucacuauagggauauaccauauuuugcuuaugcauucaccaguugacggauauauauuuguuuccaguuuugagauacaauaaauaaggcugcucuaaacauuugcaugcaggucuuugcauaagcauauuuucauuucuccuggguagauaccuaugaaugggauugcuagguuguaagguaaguauauguuuaacuuuauaagaaacugugaaacuguuuuccaaaguggcgguaccaguuuaccaucucaccagcauuaugugaaaauuccauuugcuuggcauuuuugucagcauuugguauugucacauuuuuuggguuuuuuuuuuuuuuuuaaucuuaaccauucugguagguauguagugauagcucauugugguuuccauuugcauuucccuaaugacuaaugauguugcacaucuuuucauuugcuuaucuguaucucuugugauguuuguuuaaauaucuuguguuuguugucuuaauguugaguuaugagaauucuuuauauauauucuggauaccguaacguuugucagguacauguuuggcaaauauuuucucccaaucugagagacugauuuuuaucacuaacacuaaaaauuuaucuacaguuaagaccuauuugaauguguauuuugaugacuuugcucuaaguucuuuuuuuuauuuauuuauuuuuuuuucagcuaauuuuuuuauuauacuuuaaguuuuaggguacaugugcacaaugugcagguuaguuacauauguaugcaugugccaugcuggugugcugcacccauuaacucgucauuuagcaugaguucugaacagcauuauuauuuacuuuuuucuauguuuuguguauagaggcaacauuucucacuguuuuuacauuuuuauuuuuuauauuggaucugcaguggcacucuguuguuuaaagugacaaagccuuaaauuuaaaacuugcugacaacucguuaaguagugcauucaccagggaagcugguauuccuguugagcuuccuuugagugagugcuguguaggcuuggccucugucuuuuuuuuuuuguaagugagauagggucucagucuguugcccaggcuggagugcaguggcgugaucucggcacacugaagccucuaccuccugggcugaaguaauucuucugccucagccccccgaguagcugagacuacaggcaugcgccaccaugccuggcuaauuuuuguguguuuuuguagagaugggguuugaccauguugcucaggcuagucuugaacuucuagacucaagcaauuugccugccucagccucccaaaguucugggauuacaggcaugagccacugcaccuggucaugucuuuauugaaggaagaaaauuauggcugauaaagaaagcugagcuauucucuugguuuccaauuuagagaauauauauuauccaacaauuacguauuuuaaaaauauacuuucccucuaaugaggauucaucacuugaaaaagauuacuuauaaauuaauuauacggaaccaaaagacugagaagccaugaccaguugaaucuuaucuagauuuuaaggcagucuguaaagugauaaugucucaagggugggagauaggaaaggguaaugauuccugaaaacuuacauauaaacccaguuucauaaaguaagguugucuccuguugugaaagacuucaaauaguuucacuuggcuuuuuacaagguaggaauuucauccagguaaagguacaucuacuuuaucuucuuaugaagaaaagaaauggggcuaaaaacugucgaaaucccaaaagacaggguggacaagagaggaaacuacagaagacagcauuguagaaacuggaaaacaaauggucaagugcuaagugaguuaguaaaucugagaaacccagauccuaaacuaucaguuagggaagcucaaaacuagaucuacaucauaauuauauaacauuguagcaguucuggauaccuccuggaauggagaguuggggguggagaguguauaaggaagaugaguuauaugucaauuuaagaaacaaucaaaucucucuauuuccuccccacacuggaccucuauagagaaaaaaaucgugggugucuggucuuggaggguagaggaguagucaccagauacaauugaaaucaaaguaucacacugaauacagaggagggauuagggaagcaagcaaacuagcuacugagccucacaugacccuaucccaccacuauuccccaacuuccaaacucuggccaacaaacuuuaauccucaggacaggagguugcuggggucuuuucuaagaaucugaccagcguaaaaguuuugaccuaaagauaacaauauagcuucccuagcaaaguagcccaacuagauuauccuguggugaagcccauuuuugguaaacucaaaguacagccuuuggguuucgagucagaagauucccuacuguuaaaaaugagcagacagcaaaggacuaucagucauaugaagaaaguuuccaauaugaaagagaucaagagaaucagugcaacacuaggaaacacauuauucagauguccaacaaaaagaaggaaauuugucaguauuuuuaaagagagaagaguuuuugaaaucaugaaaaaguaaguauacuauaaaaaaggaagagguuaaaaaagagcucuuggaaauuauaaauaugguagcagugaggaaagaaauuagaagaguuagaagguagaauuauagacauuucuagaaaguaaagaaaaagauuuuuguuuuuuuaaagguaguaaauaggacauagguaaaauuaaggaaauaauccaggaguucuaacaucugaacaguaggagcuccaggcagagagaacagagcagaaagggauuaucaaugaaauaauaaaagaaaaauucacagaaauaaaggacaagaguuuuacauugaaaucaucaagcaagguccaguauaauagauuuuuaaaaagacucauguuaaagacacauugugcugagccagaccacugggaagaagaucuuggaugcuuccagagagaaaaaacauaacaacaaagguuaaggauucaaaaugacuguggacuucucaaaagcagugcuggaaacuaagaugcaauggcugaugccuacauucuucugaagaauaauuauuuucgacaaugaauuauauaugcauccaaaucaccaagcgaguauaaggacagacuaaaagcauuuuaaaauauggucucaacaaauuuaccucuuguuguuuuaaaaaauauuuuagagaugcauacuuacaugucuacagaugaaaugauauguuuagaauuugcuucagaauaaugccuuuggaaggguaugaauugaugaggauguagauuuuaaaaaagaauaaccaugaguuaauaauuguugaaggcaaaugaugguaagaggguucauuauucuguuuuuuugcauauaugugaaauuuuucauaauaaaaaguaaaauacauccacagacacagacgucugucuucugcugaaagauaugccccaucaaaacaaggaagaauuaaauaagaggaaaaugcgauagagguuauuguacucaaagugugaucuccagagcaguaacaucaguauaaacugugaacuuguuagaaaugcagauucucaggccugccccagaccuaauggaucagaaacccuggauauggaguccagcauucuuucuuuaacaaacccuucaaaugauucugaugcguccuaaaguuugagaaccacuuuccuaaagcaggaaaaauagcuuugcucaaguaaagaauggacaugacugguguuuuguaucaucucauuuucuuaacugcuugcucucuggacguugauaguugcucugacauguaaaucaauugaguuguuauacauaaaaaauacuguauugugcuauuuguucuaacaaucucaacaaucgauguaaaaguucaaauuuaaggaaacucuugaguauagugauuguaucagaaaugggaagagguaugaggggaacauaugaacaugccuuauaccaaccuggcugcuugucuaacuggcaccuugacauuguuugcugacuuugucaauugaaauuuuuauuaaucuggaaugccuuuuccuccucugguaucaaaagccugucuuuccuccugggcucaacuaaaccacagcuuuucaaugaaccacuuuagaucucauucucaucuuucugucucuaccaucagauuuuuaaaauuuuauuuauuuauuuuaaacagggccuaaugcugccguccaggcuggaaugcagugaugcaaucauggcuugcugccaccuugaccuccugggcucaugauccuccugccucagccuccguaguagcugggacuacaggugcaccaccacaccuggcuauuuuuggggaguuuuuuuguuuguuuguuuguuuuuugguagagacugagucucgcuauguugcccagacugguuucaaacuccugagcucaagcaguccuccagccuuggccucucgaacagcugggauuacagugugagacacugcaccuggccauuacuaucagauuuuuuaaaauauaaauaaggacugagcaacuaugacauguguugugcuggcuauuuuauguauuaucaggaaaaaggugaaaaugauuagggagagagaaauaaagguaagaagagcuacaacuguuuuucauaucaaaccuugacucaaagaguucagaaugauuuaacucuuuaaacugugugggcuucugaguagcugaagacagugguaggugguaggcuugugguaagccgcaucccaaaauguuaucucccuaaaagauacaaaauaacuucacaucuauaucauuuugacaugaaacaacaccuugaacauuacuuguagauagauaauggcaaaacugcaaaauaaucauguaagaaaaagguaacacacucaagugcagugguccuacaugcuuuuaccccauugccgcaaggggacccuguggcaaggaaaauuagaccaagauauguuccuugagaagacagaaggagcacuagugagggagagcuggaagaaccaccggaaagauuaaauccacccuuuuuuuuuguauuuucagugcaaaaaacuaaccagacagaucagagcaggauuacaggaaaaggauuucaaaguauaaguacuuuaaagggcuagacagccauuuaaaugugauuuaaagagacacacuucugaaugucuaacuucuggaagacagaaaaggaaaacaaaagaguucuuuggaaauuggauggucaaggaaaaaauuuuuaaagaccugcaagaaaaaaaggaaccaaaaaaugagaaggccuacaacccucuucucuacuauuaaagcaaaacuccacugagguaucuagacuuuggcaaacgacagaaagaaaaagaugccauuaaacgaaggauauugaaaaaaugcccccaaaucacaaaaauaaacagaaggaaagugaaauccuuuccuuuaguuuauaaaauuagggaaaaauucauacaaaucaacuaaggaaaauuccucuaaucccguaaaacuacuuaagaagcaaaagaaaacuauuaguauacacuccaaauagaacucaaaauauacaacacuuggguuugaagauaagaagaaccaccuugagucacaaauucaaaaucaagaacaaaaaugggugaaaaccaggggaaaaaugcaaaaagaauuguacucaaagagaugaaagaaaaugacaauagauuaucuuaaaugaagaaaaaaaguuaccagauacugaaaauagagucaaaugaaaauuuaggcugggcacaguggcucacgccuguaaucccagcacuuugggaggccgaggugggcggaucaugaggucaggagaucgagaccauccuggcuaacauggugaaaucccaucucuacuaaagauauaaaaaauuagccaggcgugguggugggcgccuguagucccagcuacucgggaggcugaggcaggagaagggcaugaacccaggaggcggagcuugcagugagccgagaucgcgccacugcacuccagccugggcgacacagcgagacucugucucaaaaaaaaauaaauaaauaaaaauuucguacagguguugaagaaagaguagacaacaaugaagagaaugaaaguaagauaaaaaggaucagaaaaauuacugaaaauggaaaacagacaaggacuaauuuucauauuacuagagucucugaagaagaaaaaaagguuuuuuauuauacuuuaagcucugggauacaugugcagaaugugcagguuuguuacauagguauacaugugccauggugguuuguugcaacugccaaccugucaucuacacuagguauuucugcuaaugcuaugccuccccuuguccccaaccucccgacaggccccggcgugugauguucccaucccugugcucauauguucucauuguuuaccucccacuucuaagugagaacauacgguguuugguuuucuguuccuguguuaguuugcugagaaugaugguuuccacguucauccaugucccuacaaaggacaugaacucauucuuuuuuauggcugcauaguauuccaugguguauaugugccacauuuucuuuauccagucuaacauugaugggcaauugcuguugugaauagugcugcaguaaacauacguaugcaugugucuuuauagaagagugauuuguaauccuuuggguauauacccaguaauggcauugcuuucuagauccuugaggaauugccacacuaucuuccacaaugguugaacuaauuuacacucccaccaacagaguaaaagcguuccuauuucuccacauccucuccagcaucuauuguuuccugacuuuuuaaugaucuccauucuaacuggcgucagaugguaucucauugugguuuugauuugcauuucucuaaugaccagugauaaugagcuuuuuuucauguuuguuggccacauaaaugucuucucuugaaaagugucuguucauauccaucguccauuuuuugauuuuuuuucuuauaaaucuguuuaaguuccuuguagauucugcauauuggccauuugucaaauggauagacugcaaaaauguucucccauucuguagguugccuguucacucugaugauaguuucuuuugcugugcagaagcucuuuaguuuaauuagaucccauuugucaauuuuggcuuuuguugccauugcuuuugguguuuuagucaugaagccuuugccaaugccuauguccucaaugauauugccuagguuuucuucuaggguuuuuaugguuuugggucuuacauuuaaaucuugaauccaucuuaaguuaauuuuuguauaagguguaagggagggguccaguuucaguuuucugcauauggcuagccaguuuucccaacaccauuuauuaaauauggaauccuuucuucauugcuuguuuuugucagguuugucagagaucagauguuuguagauguguggguguuauuucugaggccucuauucuguucuggucuauauaucuguuuugguaccaguaccaugcuguuuugguuacuguagccuuguaguauaguuugaagucagguagcaugaugccuccagcuuuguucuuuuugcuuaggauugucuuggcuauaugggcucugaaaaaaauuuucuuuaaugaggcuuuauuuaaaaccauaaucaaggaaaaaugucucagaauagagaaagaggcuggagguacccauugaaaaggauacuggguacuugggaaaauuaacccagaaugauaaacugugaacaguaaaacuguuagaucaaauauaaaauucuucaaggaaaaggaacaaaucauaaaagcaaaaauaauuggauuagcaccacacuuuacaaaauuaagaaagaaggcaacagggagcagcguuuuuaaacuuagaaaaaaaauguggaucaaggauuuuauguccaaccaaguaguccuuuaaauaucaagucuuuugaaaagugauuuuaaaauaagcuauguacaacuuugauaaaaauuaaaacuuaaaauuuacaguuuagcaauacuauaugaaguauauuugcaaauaauuuauuaguuuuuaaauucacacuuuuuagugauaaauuugcaaguucuauauaaaaguaaaucuuuuuuggaagaaacaacauuuucaaguuacuauuuuuguuguuuagaagacuugaauuggcaagaauucauuuuuuuaaaaaaaauauuaugaguacauaguagguauuaaugggguagaugagauauuuugauacaggcauacaguguguaauaaucacaucgugguaaaugcagcauccaccacaagcuuuuaucauuucuuuguguuacaaacauucuauuuuuagcuauuuuuaaauguacaguaaauuuuuguucacucuagucacuguguuaugcuaucaaauacuagauucuuauuaauucuaucuaacuauauuuuuguacuuauuaacccuccacacucccucccucuaaucuucccagccucugguaaccaucauuguacuuucuguuuucaugaguucaauucuuuuuauuuuuaccucacacaaauuaguaagaacaugcaaaguuugucuuucugugccuggcuuauuucacuugacauaauguccuccaguuccauccauguuauuugaaaugacaggaucgcauccuuuuuaauggcucaauaguaguccauuguguauaucuaccacauuuucuuuauucguucaucuguugucggacacuuauaauggccauuauaaaugggaugagauaauaucucauugugguuuucaguugcauuucugucauuaguguuguugaauaccuuuucucauaugugcuugcccaguguauguugucuuuugaguaaugucuauucagaucuuucaaccauuuuuuaaguggauuacuagauuucuucuuauagacuucucucaucuccuuguauauucugguuauuaaucccuugucagauggguagcuuucaaauauuuucucccauucuguagguugucucuuuguugauuauuucuuuaucuguagagacgccuuuuaacuugaugugaucucauuuguccauuuuugcucugguugccugugcauacgugguauuucucaagaaaucuuugaccaguacaauguucuggaguuuccccaguguuuucuuuuaguaauuucagaguuugaggccuuagauuuaaauauuuaauccauuugauaugauuuuaauguauagcaagagguaggggucuaguuucauucuucugcuuaugaauauccaguuuuccuagcacuauuuauugaagcgacuguccuuuccccaauguauguucuuggcacuuuucucaaaaauaaguucacuguagguguguggauuuguuucugagcucuguucuguuucacuggucuguauaucuguuuauaugccaguaccaaacuguuuugguuacuauagcucuguaguauaauuugaagucagguagugggauuccuacaguuguguucuuuuugcuuaggauaucuuuggcuauucugggucuuuugugguucuguauacauuuuaggauuguuucuugugguuuggugaacgaugucauuguuauuuugauagggauugcaucaaaucuguagauuguuuuggguaguauggacauuuuaacaauauugauucuuccaguccaugaauaugugauaucuuuccguuguuuuguguccucuucaguuucuugaaucgcuguuuuauaguuuucauuguagagaucuuucacuucuuugguuaaguuuauuccuagguaucuuauuuuauuucuagcuauuauaaauggaauuacuugauuucuuuuucagguuuuuauuggcauauagacaugcuguugauuuuuguguauguauuuuuguauccugcaacuuuacugaauguaucaguucuaauaguuuugguggaguuuuuagguuguuucaaauauaaggucauuaucauuuccagauaagcauaauuugauuucuuucuuuccaauucauauacccuucauuucuuucucuuuuucaauugcucuagcugggacuuucaguccuauguugaauagcaauggugaaggugaacaucuuugucuuucagaucuuacaggaaaggcuuucacuuuuguuccauuuauuaugauacaggccaugggucuguuguguaugacuuuuauuauguugauguauguuuuuucuaugcccaguuuugugaggguuuuuaucaugagaggauguugaauuuuaucaguuuucucagcaucaauuuaaaugacuuuaugguuuuuguccuucauucuguggauauaauguaccacguagauuugcguauguugaaccauccuugcaucccugggauaaauuccauguggucaugaugaauaaucuuuuuaauguguuguugaauucaguuugauaguauuuuguugaggauuuuuguaucaauguucgccagggauauuggccggcaauuuucuuuguuugaugugucuuugucuguuuuugguaucuggguaauacuagccucauagaaugaguuuggaaguaucuccugcucuguuuuucggaauaguuugaguaggauugguuuaguucuuccuucgguguucaguaacguucaacagugaagccacugggucucaggcuuuucuuugcugagacuuuuuauuacagcuuugaccuuacaacuuguuauuggucucuuaagguuuuaaauuucuuccugguucaauauugguagguuguaucugucuaggaauguauucauuucuucuagguuuuccaauucuuggcauauaguugcuuauaguagccucuaauaaucuuuugaauuucugcaguaucaguuauaaugucucccuuuucaucucugauuuuaucuauuugggucuucucucuuuuucuuagguuguugaucaaagguuugucaauuuuguuuaucuuuucaaaaaaccaacuuuucauuucauugaucuuuuguauuuuuuuguuucaauuucauuugucucugauguuuauuauuuauucugcuaauuugggguuugguuugcucuuuucuuucuuuaagaugcaucauuagguugucuauuugaagguuuucuacauuuuuuaucuaagugcuuauuaauauaaaugucccucuuaguacuacuuucacuguauaccauaggcucucuuuccuuucuuuuuguucuuuuuuuuuuuuuuuuuuuuuuuuuguauuuuuguguagacagugucuugguuuauugcucaggcucaucuugaacucuugccuucaagcaguccuccugcauuggucucccaaaauguuaggauuacuggugugaaacaccacucccaaccucccauguauguuuuuguguguuuuauuuccacuuucauuuguuucaaaaaaauuguuuaauuuucuucuuuuuucauuggcccaaacuggucauucuggagcguguuguuuaguuccaaguuucucuuguuauugaauuguaguauuauugcauuguggucagagaagguacuugauaaugauuucaguuauuuugaauuuuuugauuuauuuuguggccuaacauauggucuggccuugagagugauccaugugcugaggagaauguguccucuacaacuguuguauaacaugaucuguaaauaucuuuuagguccauuuggucuauaguauagauuaagucugauguuucuugauuuucugucugaaaugaucuguccagugcugaaagugggguguugaagucuccagcuauuguauaauggucucucucuuuaguucuguuaauauuugcuuuauauaucuggguggucuaguguugcauauauauuuacuauuauuauauccuucugaauuaaccccuuugucauuauguaacgaccuucuuauuucuuguugguuuugucuugaaauguugucuaagaauagcuaagccugcuauuuuuugcuuuccauuggcauggaauaucuuuuuccauucuuuuauuuucagucugugucuuuauagaugacguguauuucuuguaggcaacagaucauugggucuugcuuuuuuuuuuuuuaauccauucagucacucugucuuuugauuggagaguuuaguccauauacauucauacuguuauuaauaagcaaggauuuacuccugccauuuuguuauuuguuuucugguuauuuuguggucuucuuuuuuuucuuucuuuccuguuuuuuuuuucuuuuuauguucgugugccggugauucucucuggugguauguuuuaauuuuuugcuuuuugucuguugcagguuuugucuguugucuguuguagauucgauguuaccaugaggcuuucaaauaacaagccauuauuuuagacucaugauaacuuagcacugguuacaaaaagaaacaaacuaagaaacagagagaauucauaaaaacucuauaauuuuaucaccccccacuuuuaaacuuuuuauuguuucucuuuauauguuauacugucugugucuucaaaaguugauguaguuaucauuuuuuguagguucaucuuuuagucuuacuacucaagauaugaguaguuuacacaccacaauuaagguguuauauauucugugauuguguacauacuauuagugauuuuuguaacuucagaugauuucuuauugcucguuaaugucuuuuuuuuuuuccccagacugaagaacuuccuuuagcagcucuuacaagacaggucuaguguugaagucccucagcuuuuguuuuucugugaaagucuuuauuuuuccaucauguuugaaggauauuuuugcuggauauacuauucuaagauaaaaguuuuuuucagcacuuuauuucauguucuauaauguuucuacugagaagucuucugcuagauguauuggagcuccauuguauauuguuucuuuucucuugcuacuuuuaggaucuuuaugcuuaaucuuaaugccuugauguagacuuauuuggauuaaaucuucuugauguucuauaaccuucuuauauguucauauugaucucuguguuuguuaauuucucuguuguuaucgcuuugaaucaaacuuucuaccuucaccucacucucuauuuauacuuuaaggccagugacucuuagaguugcccuuuuggggguauuuuguagaucuuguaggcuugcuacauucuuuauucuuuuuuuaucuccucugacuauauuuucaaauagccugucuucaagcucacucauuguaucuucugcauaauuaauuaugcuguugagagacacugauguauauuucauuuuaucaauuggauuuuucagcucuagaauuuccacuugauuucauuaaauuuguacaguuuguuaaauucagauaggagucugaauuucuucucuguuuaucuucagcuucauugagcuaacucaaaauagcuauuuugaauaccguaucuuaaagggcacauuucucugucauucugggauuuaucacuggugccuuacuuaguuuguuuggugaggucauguuuuccuggauguucuuaaugcuauggauguucauugauuucuggucauugaaaaguuagguauuuauuacagucuucgcagugugggcuucuuuguacccauucuucuuaggaagguuuuccaaguguucaaugggaacugacuguugugaucagucccuaguugcuauagcgguaucugcauuagguggcaccccaagccuaguaaugcugugacucuugcagacucacaaauaguacugccuugcugaucuuggguauaauccaagagaauucucuggauuaccaggcggaaacucuuguccucuacccuuuccccuaaauggaguuucuuugcguugagcugccuggagcugggguaaaggugacacaagcaccacuguggccacuaccacugggacuauccugggucagacccacagccaccacagcacugggucuugcccaaggcccacagugacuacugucugacuacugcugguauuuacucaaggccuaaaggcucuccaguaggugucagucaguaggugacaaauuuagccaggcuauguccuucccuuuaggguggcaagcuacccccugggccggggccuggagucagaauccuuaggugucuacuuggugcucuauuuuacuggggcugaacuagcacccaagccacaaguccuuccacucuucucuuaccuuuccucaugauagagugccuucguguguuaaccaccaccccaggccuguaaugaguacugccuggauacugccaauguucacucaagguccaagggcucuuuagucaucuuguggugaauccugcaaggccugggucucuccuuuuaggguagcgagcucccuucuggcccagggcuggucuagaaauggcauccaggagccaaggccuggaauuugggaccccaagagcccaucuggugcucuaucccaggaaagaaguaguuuuagaagcuaaguuaaggucauuaaaauauauuuuuaucaaguaauuauaaucaaauaaguucugguaagguccuguaacauuccgguaacauuguaaaaauauauuuugggaucucugacaucccauuauuuuguaugcuaauccuacuagauugugauucauaugagaggagagaucauauauaaccacaaaauuagcauuuucuuuuauuaucauuguagccaaaaaucacaguaauauugucaguguccgugccuucgagagcaaaaauuaaagacgggguuuuguuuuauuuagagauucucagaauugaagaguuaaacuaaucaagcagauacaucaagucaauauguuauaugaaagaacuggaaaugaauaauuaauaguuauaauuagcuuuccuauauauuuuccugaaaaauuugcaguuaagauuuacaaacagaaaacaaauuguuuaagauauuuuacauuuggggaugauauaguuauucagacugacuuugggagucuguuccucuuaggcuguuaagcacauuuuuauuaaguagcuuuuguuauuuuaacaucuuuuauuguagggugggcugggaagguuucucuggcuaaauauuaccguauuuuaauuaguuugaugccacuaaauuuaaggugcaccguauaauuauauacuauaguaacuauucaaauuuauaucauuuguaggauauauccuuauuucagggauguaaaacuguguguguauuggggcaguuuuuauaaugagugaaauggggaauuugagaagcagucugaaggugggaaaggaaugagucaugccauuuagaagaaguggugaccaggugagaaggaacagcaguuguaaaggacaaccaaagcuaguuaaagaaggccaauacgacuggagcagaguagacacggggaaagcaaagugguagugaggccugguuguggagagccuuguggaucauccauaaggacuuugacuuuaaugcugagcgagaugggaaguugcuggagguuugagcagaggagugauuugauccgugcaacaggaucacuugggcugcuguguuaagaauagauuguaggaggcagggauggaagcaggaaaauagaaucaggcagccuuuaaaggcuguugcagguaauccagaugagagaugcugguggcugggaccagaguuaacagugguggagauuacgaaaagcacuuggauucuggauuucuuuugaaggcaaagcugacaagauuugcagauuugcuaaugaauuccuauggagugugagagaaaugagaaaucagauuauucaggucgaagcaacuguauuguuaccauuuacagaaauguggaagccuucuugaggaaggcaaaucagaugaucaauuuuggauuauguugagaaggcuguuaggcauuaucagaagauaauagagagagcaacugaguaaaaaagucuggagaccagggaagagggcccaguuggaguuauguguaugcaugcacacguaugcguauauuacguagggcauguaugcgugugaguuuaucguuugauucuugcagcauugacgauugcuucagaauuccauuuuucccccuuguguuuagucugugauuuuauuauuagagguuuucuucaaaugucugaugagcuuuggcucuccuuaacaaugagauauaaggagagauuaagcaaccagcuucuacaaaggacuuucaugagggaaggaagaauagaguugaccgaugguguauuuuuaaguaucguuuuuguuuuuuaacuuauuuugaaaucauuucacauagaaaaguugcaagaauaauguagguaacuccuguaaguaccuagguucagaauauuauguaaaugauguaguguuuuucucaggguaucacauuagagacauagauaguggucccucauuugacaguaauuucaagaauccagcaaagggccaagggguugucuaguuuuucuucuuuguaguuucuguaucuccuugaaacuagaagguaagguccauggaauauauguuaagacuguguaaacaauaagauaccaucucacaccugucagaauggcuauuauuaaaaagucaaaaaacaacagaugcuggcaagguugcagagaaaagguaacacuuacauacuguuggugggagcauaaauuaguucaaccauuguggaaagcaguauggcgauuccucacagagcuaaaagcaaaacuaccauucaacccagcaauuccauuacugaauauauaccuagaggaauauaaauccuucugccauaaagacacaugcacucgaauguucauugcagcacuauucacaauaaaaaaaagacauggagucaaccuaaauguccaucagugacagauuagauaaagaaaaugugguacauagacaccauggaauacuaugcagacauaaaaaagagugagaucacgucuuuugcaggaacguggauggagcuggagacuauuauccuuagcauaguaaugcaggaagaguaccacauguucucauuuauaagugggaacuaaauggugggaacucauuaacacagagaagggaacaauggacucuggggucuacuugaggguagagggugagaagaagaagaggagcagaauagauaacuauuggguacuggguuuaauaccugggugaugaaacaaucuguacagcaaaccccugugguaagaguucaccuauguaacaaaccuucacauguacccccaaaccuaaaauaaaaguuaaaaaaaaagacuguaaaaaucuuauuccaucaucauccuuuucucuaauuuagcaauuauuuaugaugccucacccacugaaucuuaguuuaauaauguuugcaaaguagugaguuuuuuaaugcugcaagcauugcagaguuuaucagcuagcauauuauuauuaaaaacucaacaaaacacagucuuuuuuuuugucccauuuaauaucauaggggacuuaccuguuucugcuuaauauugaauguguuauaauccauuacuguacuuauauauuuugaugaucaaaauuguccuagauauggcuaauagaagcaccuucgagcugauuucuugguccuuuugacaaacgcguguggcuuuuuuuuuuuuuuuuuuuuuuuuuuuuuuaguacuuacuuucaagcucaagauuuuccggauucaucuuaucuuacaccucccuugccccaguccuggaccauuucucugaggagccuugcuugcuuuggauggagaaauaguaucagauaggggguagagggugagaguuucacuacucaauauaggcuuugccuugaucuuucuguuuugaacccuuuuccucagcuuucuuugauagugcuuacuuuagggguucuuucaauucaacauauccaaauagaaaaccucuagucuucugcuagaaggguaauuugguuauuuuuagggauggugucuaagcagacuaauugcuucuuacuuuuaaucaguucuucuguuuauagcuucagaggaaucuaguguuugaaguugcugauucucauucuuuuuauucuuucugugguucuuugacacaaauaagauugcaucuuaucuuguccuccgucacugcacacuuagauuucccuagucaccugugacaucuuaauuugcucguuugcuuucagauaucuaaaauuugauugaauucucuuuuuuuguuguguuuuuuccucuuuucuuuucuuuuuuuuauuuuuuuuuuagaggcagagucuugcucugucacccaggcuggaaugcagcagcaggaucuuggcucacugcacccuccgcccuaaggguucaagcaauucuccugucucagccucccaaguagcugggauuacaggugcugcgccaccacaccuggcuaauuuuucuguuuuuaguagagacuggguuuugccauguuggucaggcuagucucgaacuccugacuucaggugaucugcccgccucagccucccaaagugcugggauuacaggcgugagucacugugcccggccucuuccuucuaaucuucuuauuucuaguuuaaugccuuuuuuuaucuuuuaagugggguuuguuaagucaagaugaauguaucaaucugccaccauauuuacccacaggucuuauguauuuuuaaaugaacuuuuuuuccuuuaacaaaaguauuauguaucauuuauggaaaauacagguaagcaaaugaaaacaauuaguaaaugaaaacaauuagcucuacucauauaguuuagagguaguuacuguuaauccuugaugugauuuuuuuuauauauacaaacuugcuuauuaaaauagcuggauaauauucuauagaguagguaucauauuaggcuuuuuguuguuguuguuugguuguuuuuuuuuuuuuuuuuuuuuuacaacuuauuagaccuuuacucucauugaagugaccuucuaugaacuuauauaugcuauauaucauuauggucgggacaugaggguaagcaauaaggcaguuacaaaaccccagaaauuuuuagaaaucacacuaagagguuuuaaagacugugccagaggagauuuugguaguaucauaguucaugucuuucaugagcugggauguaguuucauggaaacacaacagagaguagaaaaccuaaccaauuuuaccguauuuuaucuuaaaaaaaaagacuauuacuguguuacauacagacuuucaaccugcccugucuucagcccagcuguacccuugauguuauggaucagagaaagccaaguaaggggagagccaauaagcaguaucaaaaugaggccaagacauuuagaaauuuacuuacaaagaugguuuacaagagaauacagacuucagaagaaccaacucuccaaauaaaaaugcugucaguuuuaaaggggggaaaauaagauuccaaaguuuccaucuagucucuacauaguaggaaaaacaaccguuuuucauacuuugcauaugauuaucauaucugcaaagguuaucauguaucuucagauaacaccuuugcagaagucaaggacauagggagucaguaguuaaaggaacagcucaagguuuuguuaauuugggaauuugggggacuuuaaaacuaagugagaugacuggauuuuuuuuucccccaucucggaguacaaagugucuuuuccccuugacuuuugaaugugaugugcaggcuuuuccauaguuacgcagaacaaggcaucaguuuugccuccaaggaagggcauuaugcauggaaaagaaaaaccgaaguauuuuucacugucuccaguguuguuuaggauagcagcagaaguauuuuacuauccaguucugaugguuuugauauauccaacaaguuaucauuuugauuaccuaacuaccuuugcucuaguuucuuauuuucaagccuuuaaauagaaugagaagcaugugugaauaggugggaguuagagguuaaaauuuuagauaagguggcaaaggaagggauucacuugagucaaaaccuuaaggaaguaacagcuaaacaaugaauauauuuggaggagaguauucuaggaagaggaaagagcggcucugagguuaauucagggguauagaauuugucguggagagcacugaaggacuuugaacagaggagugacaugauuugguuuuccuuuuaaucauuccguuauauauacuaaauacaugguaauagauagugauaggugcaaaaaaaaaaaucacaauuuccaugcuuuucuuauaucuuaacagaguugggauacaguuaucugaagcccaguguuacaaauuggaaucaagaaaacaaccucuuuaacuuaccauuuaauucaucuacaacuuaaaauguuuuaugcugccagauuaucuaaagcuuguuucuuuuguccaccuuuguuuguguuuuuauguuaaauaaauaaucccuaugaauugauagagacagauguuuuagagaagcuuguauuguuucaaaacuaaauuaguguuuuuuaaaacuugauuuuuuauugaauaaaaaauagguuuuuuaaagcauauaacugacauuugagugcuuuuacuauuccaaacauugcucaaaauguuuucacuauuugcacaugcaaaauguggauuaucacauucuguccucucaaaaauccagugaaauaaguuuuauuauuacccccacauucauagauaaggaauuggaacuucagagaguuuaaauugccuaagguuacaaaaguuuauauaccaucugugaccucugauaggcuggaaaguaacauaagcaaguucuguauaugaauauacugauuccaaggaaagcuaaauugguaauuguuggaaaaagaaaaaaaaaaggcuaauauuaagcccccaagcaggaaaacaaguaucugaaagaacagaccuuuggcaaguuuuaagaaaagggaccccaggaacaguguaauuuucaaaggauauguuaaucgugguauucaccguguuuugcgaaaaugccucaggagccauuuggugagagugacaaugaucuugaggggaaaagaaaaugguagggcucuucuuuccuuccccauucccauacauuuuaaaaauauguagguauuaaaguuaagauuugggaagguggggcagcagcagacaggguucuaucacuuaaaacgaaaauugggaaaacauuacacuaaauuuggugcuacuggucacuaaaagucuuuucacucucuuuauuuugaucccaugcugaaacuuuuauauuugauuuuucugaauaggauucuuacaaggagcacauuuaccagaaaauugaaaugucuggcuaucauggcauuuguuccuugcuauaaaucauuaaauugucaguaugguauguucauugauacauuccuaaaucucuuagaagcaucguagguuagacuugagagucucucuaugucuggggcacugacaagauguaguuucuagauuugcagaacuuuguuuacaugccuuggacuguggguauuuucccaguaucauaccauguauguuagguacuagauauagcuaguuggccuccuuuaacaccucaguccucauugugucauuagccugcccaguggaugauaaucucauguagucuauuagacucccucaaauagacuacaugagauuauuagacucauauagucuaauagacuacaugagauuauuagacucauauagucuaauagacuacaugagauuauuagacucccucuaguagaagaaggcauaggagcuuucuucuacuaguuucauaguuuuagauauuuuauuucagauuuuaauucacuuacaauugaauuuugcauauggugagaaguaagcauuuaauuucauuguucugcauguggauauccaguuuuccuaacacgauuuguuaaagagacugucucucuaguagagggagucuaauagacuacaugagacuaucauccacugggcaggcuaaauucauuauuaguaaggcuaaauucauuauucuucagauuggauuagugccuaaaaucauuuauuuuuaacugacuuccgugauauacuaagagaacagaucuucuacuugauuaagcuguggguucuacugucagguauuuucauuacaacuuuauuucaccaaacuguaacuguagcaggacgagccgcagacaaaaccucucagacaccgaguuguagaaggaagggcuuuauucagcugggagcauuggcaagcuacugccucaaaauccgagcuccucaagugcacaauuucugucccuuuuaagggcucacaacacuaaagauuucacaugaaagggucgugauugauuugagcaagcaggggguacgugacaggggcugcaugcacugguggucagagagaaacagaacagggcagggaguuucacagcguucuucuauacaaugucuggaaucuaugaauaacaucgguuuuuaaguuaugaguugauuuuuaacuacuggguuuaggccaggcaggcccauguccaguuuugggccuggugccgggcugccugucuuugguuuuacuucccuguuguuuuuucuuagaacagguacugaguauaaaauaauaugagagggucuuucucuuccuucauaacaaugauuaagauugacagccagcccuuuuauuuuaaaguaacuuuuuuuuacauuuuaaaaaaauuaauuuuaaaaguugacauguaacauguauuuauuguacacaacaugcuuuuuugaaguauauauacauugugaaaugguuaagucuagcuaacaaauauauuaccucacauaguuaucauuuuugcagugagaauacugagcauccacucucagcauuuuucaagaacauaguauguaaucauuaacuauagucaccacguuguacaauuuaucucuuaaacuuaauccuccuaucuaaccauaaguauguguccuuuaaccaacaucucccuaacccuccucaccugcuaaacacuccagacucugguaacuaccauucuacucucuauuuccaugagaucaacuuuuuuaagauucuacauaugagggaaauaaugcguuauuugucugucugugccaggcuuguuucauuuaaugcccuccagauucauucauauugucaaaaaugacagcauuuucuucuuuuaaauuccugaaucagucagauuugguggcucaugccuguaauuccagcacuuugggagguccagacuggaggaucacuugaagccaggacuucaagacagcuugagcagcauagcauagcaagacccugucccuacaaaaaauuuaaaaaaugagcuaggcaugguagaaugugccugcaguccuagcuacugaggaggguggggcaggaggaucacuucaccccaagaguccaagguugcagugagcuaugaucaugccacugcucuccagccugggcaacagagcaagacccugugucuuaaaaaaacaacaaaaaaauggcugcguaguauuccauuguguucauauacuauauuuucuuuauccauucaucuguuaauggacacugagguugauuccauaucuuggcuguugugaauagcuauaauaaaaguaggaaguacagaugucucuucaacauacugauuuuauuuacuuuagauauauaccaaggaguggcauuacugaauuauaugguaguuuuuuuuuaauuuuucgaggaaccuccaugguguuuucuuuaguggcucuacuaauucacauuaccaacaaguguaggaggauucccuuuucuccacacucuugccaacacuuaacucuauuuugucuuuuugcuaauagccauuucaacaggagauaauaucucauuaugguuuucauuuguauuugccugaugauuuaugacauugagcauuuuuucauauaccuguugacaauuuauauguuuucuucugagaaauguuuguucagguguuugugcauuuuuuuaauuggguuauuuucuuguuauugaguugaguuccugauauuuuucggauauuaaucccuuaucagagauauaguuugcagauauuuucucccauucuguggguuuucucuucacuuuguugauugcuucuuuugcugugcagaagcuuuuuaguuuguugaaaucucaucuauuuuuuauuuuguugccuaugcuuuugagguuucauucaaaaaauucuugccagaccaaugucauggagcauugcuccugugcuuucuucuacuaguuucauaguuuuaggucuuauauuucagauuuuaauucacuuucaguugaauuuugcauaauagugagaaguaagcauuuaauuucauucuucugcauguggauauccaguuuuccuaacacuauuuguuaaagagacuguccuuuccccauuguguguuuuucacaucucugucaaaaauuaguugguuguaaaugcauggauuuauuucuggacucuauucuauuacaauggucugugugucuauuuuuaugcuaguuaccuguugauuugauuccuauaguuuuguguaguauauuuugaagucagguagugugauccucuccagcauuguucuucuugcuuaagauuccuuuggcucuuuggggucuuuucugguuccacaugaguuuuaggauuaccuuuucuguuuuuaugaaaaaugucauugguaucuuaagaaggauugcauugaaucuguagauugcuuuggguaguguagacauuuuaacaauacagucaugugucacacagugauguuucagucaucagccuaccaccuuuucuuuuuuuuuuuuuuuuuuuuugagaugaagucucacucugucacaaggcuggagugcaguggcgcaaucuuggcucacugcaaccucugccucccagguucaagcaauucuaccucagccucccgaguagcugggacuacaggcaugcgccaccaugcccagcuaauauuuuuauuuucaguagagaugggguuucaccauguuggccaggauggucucaaucucuugaccucaugaucugccugccucagccucccaaaaugcugggauuacaggcaugagccaccacgucugcccagcauaccacuucuaagccaguagucccauaaggucauaauggggcugaagauuaucuaucaccuaaugauguuguagccaucauaagaccacagcuuaaugcauaaccauuucuauuuuuagauacacaaauaguuacccuuguauaauaauugucuaaaguauucaguagaguaacaugcuguccagguuuguagcuuggaagcaauaagcuguacuguauagcuuaggugaguaguaggaguaguaggcuauaccaucuagauauguauagcugacgaaaucaccaaaaagcauauuucucagaacacauccccauugcuaagugacacaagacuguauaaauucuucuaauucaugaacaugggaucucauuccauuuauuuuugucuucuauuucuuucuugaauguuuuauaguuuucaguguagagaucuuucacuuccuugguugaauuuauuccuaaguauuuuauuuucuuuuuguagcuauucuaaaugggauuauuuucuucuuuuuuuuccccagauaguucauuguuaguguauaaaaacacuagugauuuuuuuauguugauuuuguucccugcaagcuuacugaauucauuuauuaguucugacgguauuuugguggagucuuuaggguuuucuauauauaagggucauguaaucugcagacagggacaauuuaauuuauuucuuuugucuugccuaauuguucuggcuaggacuucuaguacuaugcugaauagaaguugcaagagucgguauucuugucuuguucaggaucuuggagaaaaagcucaacuuuucccuguucaguguauuagcugugaguuguugcauauggccuuuaguguguugagguacauuucuucuauaacuaauuuguugaguguuuuuaugaaaggauguugaauuuuguccagugcuuuuucugcaucuauugaucauaggguuuuuguccaucaauucuguuaaugugauguaccacauuuauugauuuguuuguguugaaccauuguuggaucauugcaucacuugaucaugauguuuaauuuccauguaugugugaauuuuccaaagcuccuccuuuuauugacuucuaguuuuauaccauuguggucagaaaagauacucuauaugauuucaguuuucuuaaauuuguuaagauuuguuuuguggucuaacauaucuauugugaggaacgucccauguguaguuaagaagaauaauauauucugcaacugaaauguucuguguauauguguuaggcccauuugguccagaguauaguuuaauucugauguuuucuuguuaauuuucucucuagaugaucuguccauugcugaaagugagguguugaauuucccuacuauuauuguguguagucuuucucuccagaucuguuaauauaugcuuuauauauuuagguguuccaguguuggaugcauauuauauuuauaauugugauauccucuugcugaauuaucaauauauaauaaccuuugucucuuuuuuaguuuuugacuuaaagucuauuucaucugauagaaguauagcuauuccuacugucuuuugguuucuaguugcauagaauaucuuuuuaaaucucuuuacuuucaguauguauauguugaaaugagucccuuauaggcaauauauagaugggucuuuuuaaaaauccaaccagucacucugugucuuuugauuggagaauuuaauccauuuauauuuaaggcauuuauguauugauagauaagggcuuaacugcugccacuuguuuccuaauuguuuucuauucuuacugucauuguggcuaagugauuaucucuaauaguacauuugauuccuugcuuuauauuuauuuuuuguauuuauugcagguuuuuugcuuugugauuaccauaagguuuacaaaaaaaaauaguuauuuuaaacugauaacaaccuaaaaauaaacucuuuuuacuacacugucccucaguguuuugaauuuuugauguuacaauuuacaucauuauugcauauucuuuaccaaauuuugaauccagguuugcaaaguuuucuguucuuauucuuugaauaaccuuucuaccuguuugccuuucucuacucccucuugaacucuaaugacucaaaaauuugcuuuuaaugcuaucucauaaauuccguaagcuuucuuuuauuccuuuucaaucuuacuucuuuuuuuccugaccauauauuuucaaauaaccugccuucaaguucacagaucuuuugcuucuuugauuuugcuauugauguucuuuauugcauuuuucauuuuauucauuguauuuuucagcuccaguauuucuguuugauuuucuuuuaauuauuauuucaauccauuaauuuucucaucuugucauuugcuauuuuccucauuuuguucaauguuucuguguauuuucuugaaguucauugagcuuccuuaaaauagcuguuugaauucuuugucagacuuuugagacaucuccaucucuuuuggguuugucauuggaaguuuauuuugucuguuugauaaggucauguuucccugguuguucuggauccuuccuguugugcaucuauauccgcauguugaagaaauagguacuuauuggaauguuugcagucuggcuuuaucuggcucuuuaucaguaagcauguuguuagauccugggcaggucaucuggugugaucucuaagcccaugacuguugcaacuguuacagcauuaggcuuucuguacccagaauuaccauggucaguauaacaauagacuagaaucuguuguuaccacggcuggcacagcucuggggugcaucugaaaaucaugaggccuaccuguuacugagguuugacugaaaccuaaggcugcugucaucauccagcagugaugggagccagagauugaguccauuuugugagggcuauaguuuaccaccugucacugggauaggugaggagauucaguucacagauaccaaccuggauucaguuaccaugaggggucugccuggcacuggauuuuuacuguggcaggcccaguauuaggaaccaagggaaaguccuacacuucucuuuuuuuccucaagcagaggagauaucucugcauucugcugaguaggauugugggaggguugacacagauacuguaaaauuauccuuucuacccucuucaauggguauuuucuuauuaguaugccauaaacagguauugugaacuuucacuugguuuucucagcucuuuugaagauguguuaaugcauggauaguuauucaaaaugauguuuccacagggggaugaucacuggagaguccucuuucuccaucuggcucugccuucuuauaacauuaauuuguuucauuacaaaaguaaugucuauccauuaucaaacucuuaccaaauacaaaaauuucuaaagaagaaaaccacuuguaauucuaacacuaagggccaaccacuuuuugcauuuuguugaauguuuaaguuuuucacuuacaaaaacuuguaaaauuuagaaguaauuguacauucuuaaaaucuuguaaaaauagaguaaauggguuccauuuauucauccaguuuccaucuauggucugauuuuacauagcuauaguaaaauaucaaaaacaggaaauuaacauugguacaacucaccuuaauuuauauuuuaccaguuuuacauauacucaucugugcaucuguguaguucuaugcaaauuuaucacuuagauucuuguaacaaucaucacagucaaauuacagaacuguuuuauugccccauagauuucuuaugcuacuuuuuuuuuuuuuuuuucuuuuuuuuggagacagagucucacucuguugcccaggcuggagugcuauggcacaaucuuggcucacugcagccucugccucucugguucaagcgauccucuggacucagccucccaaguagcugggacuacaggcaugcaccaccaugcccagcuaauuuuuguauuuuugguagagaugggguuucgccauguugaccaggcuagucuugaacccugagcucaagcuaucugcccaccucagccucccaaagugcuaggauuacaggcgugagcuaccacguccggcuucauaugcuaccucuuuauaguuacaacuuucucccuucauucuacucucuaaucccuaaccgcuggaaaccacuaagcuguucugcagucccauaauuuuauuaucuugaggauuuuauaaaaguggaaucauacaguauauagcuuuuugagauuggcuuauuucacucagcauaauuuccuugagaauccacuaaguugcugaaugcaucaauaauugguuccuuuuuauugcuggguaguauuccaucucuguaccacaguuuaggcauucaccaauugaaggacauuuggguuauuuccaguuuggggcuguuacaaauaaagcuuuuaugaauauuuuucuguauguuuuuguguggacauuaguuuucugaauuuuauguucagcauucaauaaagaggaucaccuggaaccagaaaccacauuagauauuuuagcagaaaguguuuaauauaggaaauuguucaaacaguugugggagaagugaaagaauaaaagaaaaacauugagguaauacagaagugauaauugcaaggaccagcuucuaauucuuagacuacagcaacaaagagaagugguuuggguuaucagaaccuguaaguauggagggauaguccugcagaggugggacucagaagaaaaguugcugccugcugguguuuguaccauuaccuuaggacccuccuggaaugaggcuuaauaaaccucugagcugaaagggccaccuagcuaaugaguacuuccggaacucagagaaaggaucucugaagaguugaggcucagcuggagaggguugcucuuuaucugcucuuguuaucucagaagcuuaaaggaagugcuuugugcagcugggucucagacaucuagaagggggauuauagcucguguaucuuauacucgaauaucccacuaaucuguaaaggaaauguuguggagcgacaccucauacaacuaagaaguggcgcaugcguagcugguacuggcaucucugagguaucuagaugaagcugguccagggaguuuuaaaagaaccuuuugaguggaacugacugccacugccagggcuaaggacuuuugcugggcagaugcugauggaaacagugugcagacagcaaggugcaaguuccuucuaucuuguuccuggcuucuaauccuuaucuaaugucccacauugacagaacccaauaaaagggggcuggcagaggagaaauauaguuugcagcaucccaguuccaguagcacaaaacaguauauagaaggguggauuuaagagagauaauagguuguuaaguggcauucuuaucaucaaaauccuuuuugcuuuugaggaauuccccacuaugugaguggaaggucuccuucaaaugaucuguaaagaccagauacuuaauugcuuccucuauccuacaaucuccuaucuuguuaacuccccuuaguuagcauaugggcauaugaauuaggccuaaacuaucagaauguugcgcuguccuucucuacccccccuuuuccuuguuuuccucuccagccuuacuuugauucuauaacaggaccaauacagagaaucaagagacaggaaguuuuucuucugauagugcuggcagcaggagaaugcaguuuccaguagaagcagugccaguaguggcuuuacaggguccagaaguggaagcaguccuguccauacaaauggcaccuguggugcaaucccagcagggguuuuuguugccuagucuacccuggcuccuuuccauuuucugaucucaguucuuuguauuucuuagcaauaugaacugccuaauaccuucuaaaugaauuccuuuucuucuuaagugagcaagaaucaauuucuguggcuuacaauauagagcacugauugauucaucuuguuuguaccuaauaggauucauuuagcugucuuguugaguaaagaaauucuaauauuuuguguuuauuuguaaaaacagaaaagagaugcuagacuuagacaauuuuaagucuucagccucacaaguguuuggcaggauauuuggaaauuaucagauauccuacugucaggguagaauagggucaaaucuccauugugaugguggugcuaagugucuguaacucuaacagaaaaaucagccaaccauuuuucugacugguagaaccugggaaaguuacuugcuuuaaccagggcuauuagaaagcaaguugaaaacuugaaaaaggagagagcuagaggaagggaucucagaauuguauauauaaacucuucaagucucugguugacuccugaaccaugcaugugugcaccugacugagagcagucugaaccauguccgucauggcagagaugugagagagcuaaaacuccauuaaagaaaaccugccaucauuuuagcuguaggaaccaggcaaaagaaccuagauaguaaggagauaauccuaaauuacagcgccagagaaagagaaccuaaaauucugaguauaaaacuccgggccacuugcgguggcucaugccucuagucccagcacuuugggagaucaaggcagauggguugugugaguccaggagcucgagaccagggccugggcaacauggcaagaccuuguuucuacaaaaaauacaaaaauuauccagguguaguggcaugcaucuguggucucagcuacuccagaggcugaggugggaggaucaugugagcccaggaggcagagguugcagugagccaagauugcaccacuccagccuaggucacaaagugagacgcuguguccaaaaaacaaacaaaaaacacugcucaagucuuuaccagaccacccugggcaacaaugcaaguuugggcccuagccuucugggugccaagaaggggaaagaggccuuaaauaugaagacuuuucuuuaucugcuugccuucacccgcaucccccauagcacccuguacccuauucucuguaagaaugucugauuuagucuguccagaggguggagaguagggccucuaauguuacuaugcgguaggugaguagucaccaaugcuugggaugggcaugugggguuucaggggucuaguugcaccuuuuaaugacucagucaauucuggucucagcuccauccaugccuuaaccucuagugcuaccugcugccuccaguuccuuuacuucuccaauguugugugcaaauuggcuugauucuuuugucuucuuuucccugguagauuuuuaauuuucaguuuucucaagccugugaaacugguccaguuuucccauagaacugauguuuaugguuucuuuugcauaaaccuagcacuugacccucccagucuugaaacuugagaaaguuacauuugucuuaucugaauuccuuucucaggaagccaaccaucaggccucccagguaguaucaaagaacugaaaacuuaccagaucacugcaucuggacaaugagaugccagaacucuuaccuggcauaagugccuaaccaaccaccugcuuccuguugagcaacuccuuuuccuuaccccucccuaagucuuauguuuccacacaugguuauauuucuucccuccucuauagaccccugauuuuaguuaaucggggagauagauuugagacugaccucccgucucaacuuuagcacccuauaaagccuucuucccuggcaauaaucauugucucagugauuggcuugcugugcugugagcagcaggaccuagaccaaaccccugguguuuugguaacaccuguuaagucauuuaccacauuccaacugugaauuuuggugauaaguuuuuucuuuuucuuuuggacauuuaugucucuuuuguuccuauaagguuauuuugguagggaguagguauaagugccauggauuuauucaccuuuugaaauuuuuuuguccuuaacagugaguguugacaugagaaaauauggaacccacuuuuuuauagaugucuuuuuccuguagcaugcauucuuagugguggugauacuugguucuucgggaggguugaaaucauagauaaaacaaugguuuauggccccaaaaaauucuaauggacaaaaaucuuauccuuaguauuuaauugugggguagaggguuugguaaugcaaaaaccuugagaaacaguguccuauagcauuuccuuuauucuugaaauuaauuaacuuuacagaauauauauucguguuaaucuuucugugucuguuuuuccugggcauagugugucuuucuguuauguauguuauauuuucauguuugaaaacaccagcuaaaguauuugcuuuaucuccuuugauacucuacauuauuauauuucuuucauuuugugcuuuucucaaaucuguuuaacauguccaugacuuuuuuuuuuuuuuuuuuuuuugagacggagucuugcucugucgccgggcuggaguacaguagcgccaucuugguucacugcaacuucuaccucccggguucaagugauucuccugccucagccuccugaguagcugggacuacaggcgcgcgccaccacacccagcuaauuuuuguauuuuuaguagagaugggguuucaccauguuggacaagauggucucgaucuccugaccccgugauccacccaccucgccucccaaagugcugggauuacaggcgugggccauccaugacuuuuuaaaccuggcuuuuuguuguuguuucccacguuuuuaacucuguuuuuuguuuuuuuaacucugucagcccucuuuucaucacuugucaccuuaauucuucuuuaaacuuuuuagucuuuuuuuccuuuagaucggggguccucaaacccugggccacagaccaguaccaguccauggccuguuaggaaccaggccgcacaccaggaggugagugucaggcaagccgacauuaccuccugagcucugccuccugucagaucagcagcagcauuagauucucauaggagugcaaacccuaucgugaacuauuuaugcgagggaucuagguugcacgcuccuuaugagaaucuaaugccugaugaucaagguggaacaguuucaucccagaaccauuccccgcaaccugucuuuggaaaaacugucuuccaugaaaccgaucccuggucccaaaaaguuuguggacugcugccuuagaucauaucuuauauuuaucaccucucaauguuuuccaucuaauuuuggccucuauccuacauuuguuucuuucuaauaauuacuucucagcaccaaaacaaggaaaaugagaccagugaggaacuuaccucaaucacaaaauuuaaggaagcaagaaaaaacucaauaaucaagauaaauauuuuauugcaauauuuuuuaaaaggacuaaauuacuguauaaugagcaaaauaucaaaauuuuuaauaaagacaggauugauuguuacugaaugaaacaaucuguuagaaguuuggggcacauauguguguguaauauagugaugugagcuuuauugcauaauacauccucuuaaccaaaucugucauuuccuuugcccuguagacucaucuucucucguuuuuuuuuuuuuuuucacuuuguugagauguaaaacuuuuguguuauucacagacuuucuauaccacuuacaauucaugcuuuucucuucugugccaccuaugcuccagaucauagaugguagaaauggcucccuugucugcauaagaagguguuugccagagaaaauggugaauuaugagcuauauguucuuuuauuuuucuaaaacuuuaauaaguauauuuaacacauuacaaaauguaaaacauuuuaagaaauacuggcuggaaauauaaugggaauuaucauggaguaaaaguuuaaaacuccugggcuacuuacagcaauagacugaucaucugcuuuacuuuauuugguucuuuagauuagcauuucccaaucuuuuuggcaccagggaccaguuucaugaaagacaauuuuuccauguagugggugacgggggauggcuuugggaugaaacucuuccaccucagaucaucaaccauuagauucucauaaggagcgaacaaccuagauccuuuguauacacaguucguuguaggguuugugcuccuaugaggaucuaaugccgcugcugaucugacaggaggcagagcucaggugguaaugcuugcuugccugcugcuuacugccugcugugcggcccaguuacuaacagcccauggacuggcacggguuugugaccuagagucuggggacuccugcuuuacauagcauauguuucauuuccuccaagaagcuauucucaguaauuagacuugauucuuaacaugccuggauauuuauaauucaguuaaauuuaugaucauuauuuaugaauguuggacguuaucgcuuaugucuuucuguauuuauaauuacugaagcaggauaugcauuguuuuucccuuuugcuucuuucuagcacacucuacuucucauuuguagguuuauuauuguccagcacauacugauucaggaaauuuaacuugaauccuuuaaucagucagaaccaugauuucuuaucuuaaguuguuucauagccuaaagaaaaugguagaguuaguuuauauuguguuugcuaaauaaacugaugagauaaaagguggauguuguuaagggagggagagaauaaacaauaaacccugggaggaguacaggauguaaauuguguuaagcaaauaaguucacugucguguugcccagagcggauucuuuucccuccaagguuaagaaucuuuuuaggagaggauauugauugacucucucuacuguaucugguggaaaaagaggugguaaaugugauguauuccugucauauuuuaauucauuuauugagauuaaaaacaaggauguaaaacauucauuuuuuauauucuugagucaagagcacugaaucaaaaaguugacauuuucacuaaauguuuacaccuuaaugcggaguuuucucuagauagcucauguagaucuuauguaauauucauuuuauuuuuuuccuuuagcuggaagugcuccugguuguuacuaucaaagacauguaaaagccuagaaguuaauuuuagauacuuaaagggaaauguuaacauuuuuaucuugcuuuguuaaauuucauaagauuugauaaaugagauaucaagaauauuuaaugaaauaaaauuauuaaugggcauuuacuuuugaauaauggaguaagaaaaaaguaguaaaugucuacucuaaaacuuauuuuggccuuaaaaaauauauaugcuuuuagcucggcacaauagcuugugccuguaaccccagcaacaugagaggccaaggugggaggauuguuuaaggccaggaguucgagaccagccugggcaacauagcaaggcuccaucuuuuuuuuuuuuuuuuuuuuuuuuuuugagacggaggacucacucugucacccaggcuggagagcaguggcgcaaucucggcucacugaaaccucggccucccggguuuaagcaauucucugccucagccucccaaguagcugggauuacaggugcccaccaccacgcccagcugauuuuuguauuuuuaguagagacaggauuucaccaucuuggccaggcuggucuugaacuccugaccucgugacccaccugccuuggccuuccaaagugcugggauuacaugcaugagccaccgugcccagccagcaagccuacauuuuuaaaaaauuuuaaaaauuagcagggcauggugguaugugccaguagucccaguugggaggcaugaggaucaccugaacccaggaguucaaggcuggagugaggcuguguucaugccauugcacuccaaccugggcaauagagcaagacccucaccucaaaaauaaauaaaaauaaaaguuauccuuuuggugguguucucacuaguuaacucaaagcauuugaugaaaaauaucagcucuguuuuagaaauagauguuuguagcauaugugacaacucauuuguaagaguagugagugaaauuuggcuuuugguaacugugccuuuguacauucuuaucuucagacaaguuauuugagcagaaaaauaaaaaguaacaagucucccaccagcacagaaugaguauguucauguuuuggcuuugggguguaacacuucuaaggauauaauuagcuuugcuuuucauuuucuacuuuuucuccacagccucacgauuuugaugaaugucgauuugauauuaguguaaaugauaguguuugguaucuucgugcucaggauccagaucauagacagcaauggauagaugccauugaacagcacaagguaagaucccuaauguuuaccuguccauggaggacuagguaagagauuguugacaauaccuuaaaaaaaaaguugacaugugacauuaguuacugaaacauugaacauuauuuggaugauaaagauuaaagcaguucauauguaaauuuuugaaauaauuuuuauuuuuaacacuuuaguuguacuaaggguauuugcuaugauaaauauuacucggcugggcaugguggcucacgccuguauucccagcacuuugggaggccgaggcagguggaucagcugaggucaggagcaauaccagccuggccagcauggugaaaucccuuuucuacuaaaaauacaaaaauuagccgugcuuaguggugagcaccuguaaucccaccuacucaggaggcugaggcaguagaaccgcuugaauccgggaggcagagguugcgguaagccaagauugggcuacugcacuccagccugggcaacagagcaagacuccaucucaaaaaaaaaaaagauaaauauuuuucauuguuaacuacaucaaaaauauacccuuuuucauaaaacacauuucgauuuuuuauuuagguuuugcuucauaauaaauaccuuuuuaaugaucuaaauaaaaggauuuuugaaauaacauuggauuauaaaaccccaacuuauaaaaguuucaauguugauuuuuguuauaacuuuuuggguaaauucuuaguacgaacauuuguaaaucaguuauucuuuguaaaugugaggcuaucuaaugauaaaccuauagaaagucuuuuuuauauaaauauauaagguacauucauauaauuuaagcuagucuuugacuucuguuaauaaauauuaaguagacuaaagaaauacauuaauaaaucuguauuauuagcuaauucaguaauaccaugauaaaacagagaacguucuaaauccaccaugucauucuugaguaugacuuaagagaaguuuugcuuguuuacguacuugccuauacuuguucguuugaguuucacaaaguuguaguugaaacaccuguuuugguuauuucuaacaggcacaaaacacacacacacauaccacacacacacacacacacacauuuuuaacaggcacaaaacacacacacacacaccacacacacacacacacgcgcgccuauacccauacacccaagaaaaaccagucuggcuugagaaagaaaagcuaacacgauugauaaagaaguaugcgauugugaaaucucaggcacuguuuuggguauuuuuaacaagcacaaaacacacacacacaccccuacacccacacacccaagaaaaaccagucucaccugagauuucacaauugcauacuucuuuaucaaucguauuagcuuuucuuucuugguuuauugauuuaagauuucucccagccuaaauaaaauugacuauguuaccuuucuuuuuuuucuuuguuuuagcuuuaggacuauauauuuaaacuuuaguguuaaguuuuuaaaacauuuucuaagucuuaguuaucuugguaauguuacuucagaaaagucuaaauauggaaaaaaauuauuguuuuucuauuauuuaaaagagaaaugagcuacuauucaaaaaaucucaaugcucuggagccaggccaugcaugcagccucugccauguaugacauaugugagcuuggcuguguuaauuaaccucuucuuaguguuuauucucagcugccauguugguacuucugcucaaaguaguaguaagacauaaaugagauaauaugcaaaguuacuuaccagaaugacugauguauuuccccauuuauggcauauaggaaaagcaagagacuuggagucucaacuaaauucacuaaauuauaccaucuuguuucuggaugaagaguuuuacguuaggugagagaagcuaaaugugcauauaaggagaacagccuguuucauguuauuuaaucagggccagccgucucacuagugauuaaagauguuauuaaguagaauuaauuucuauauuuuuaauggagaugaccuuuaagggcuuaaucaguugauuuuuauuacagggcaaguuuuuuucuguuuuaauuaaacauauuuuauuuugcucacuuuucucuguuaaguccaaugacaguuccuuugcaagguucccguuuuguguuuucuuccuuuagugaagauuaaugcacgaaguauauauuucuccuuuaguguugauuucuuuacaucuuugaacaauggauagauuuaaucuuugggucucucucagagcagugggacuuaagcugagauaacaaauuuugagugauuuuuaguuccugaaaaaaauacucaacugcaggguugugaugcauuguacaaguuugcccuuucuuuuuuuuuuuuuuuuuuuuuuugagaugaggucacuuugucacccagcauggagugugaucucggcucacuucagccucugccuccucgguucaaacgauccucucaccuuagccucccaaguagcugggacuacaggcaugcaccaccgugccuggcuaauuaauuuuuuguauuuuugguagagacacgguuucgccauguugcccaggcugaucuugaaccccugaacucaagugaucugcccaugccagcuucccaaaaugcugggauuacaggugucagccucugcagccagccacccuuucuuauuuuuaaagauaguuuauuuguagacuaggagaaaucauuguuaauuguuguuaauauuauuuaauguacuaaaguaaaauaugugauguaugccaacugagcagccuaucagugaauauuuaagugaauucauauuuagaauaugaauucuaaaaguaaauuguugaguuauuuaacauguaagaaggagaaauuucaaauguugucauuguuuuuuuuccucccauagaccagggcuagugagauguuucuugauucauucuucaguaucauuaaggaauauugauuguggaagcuaaguuuaguaauuuuacuauuuaaguaugcauuaucgucuugauccucuauauaaaacuguacaggcauaaugaugauaaugauaggagcuaacacuuauugaggaucaccaaguacuaaucauuguauuaagugcuuuauguguuuuauuuucucccuacuauccugaaaaauaaaguaguauuuugcagaagaggaaacagguuuagauuaaaauuaaguaauuugccugagacuguacugucuuuuaguuugugauuucugaguauucaauuuuguguuaauucucuugucugucuguuaccauuaguaaacggacuguuuaugaacaauucccaugagcuaaccuccugcaaauugugguguauaaucugaguucuccuacuauaccuaugcaagauaaauaugaacucauuuuucuuuucgcccguggauugucaaacaggacaguauauuauauugguaacuguuucaguagcggauuucagacuccagagucuggcaaauguggauuugaauccuggcacuacuauguauuagacuagugcaaaaguaacugugauuuuggaccaugauuuuuuaaaucauuuuaacuaggcucaaacacaucuuuauuaaucaaaauaggaaccauuacaaucaacacauuuuuaccaauaagaaauaaguuuguuuauuccuguagcauaaaaaucugugcuucgggauucuacaaacucuuggaaagcauuuucugcauccugcugguuguggaagcauuuucccugcaaaaaguugucaagaugcuugaagaagugguagucaguuggcaagaggucaggugaauauggcggaugaggcaaaacuuuguagcccaguuuguucaacuuuugaaacauugguugugcaaugugcagucaagacauugugaagaagaauugggcccuuucuguugaccagugcuggcuguaggcauugcaucgcaucuauuugcugaacauacuuuucagauguaaugguuucaccgggauucagaaagcuguagugguucagaccggcagcagaccaccaaacagugaccaugaccuuuuuuuggugcaaguuuggcuuugggaagugcuuuggaacuucuucuugguccagccacugagcuggucgucaccaguugcuguauaaaauccacuuuucgucacaugucacaauccgaucaagaaaugguucuuuauuguuguguagaauaagagaagaugacacuucaaaacuugcgauuuuuaaaauuuucacucagcucaugaggcauccacuuaauugaguuuuuucaccuuuccaauuugcuucaaaucccaaacaacuguagaauggucgacauugaguucuucggcaacuucuuguguaguuguaagaggaucagcuuccaugauuggucuuaguuggucguugucaacuucagauggccagccacuacucuucucaucuugaaggcucucaucuccuuugcaaacuucuugaaacaccaccgcacuguauguucguuagcaguuccugggccaaaugcauuguugauguugcagguugucucugcugcuuuaugacccauuuugcacucaaauaagaaaaucuuuugaauuugcuuuauuugcuuuuugucugacaucauuuuuguagucuaaaauagauauaaacagcaaguaauaagucauuagcaaaaaacaaagcaagaaaugcacauuaaaauaauguauaauauaaccacauuuauuuaagaauguaauccaauaucaaacggcaaauuucaacaaugcaaaaacugcauuagcaccaacuaauacuagcuaaguggccuugguaaguuauugaaaggaggaaaauaaugauaguuuacgguauguguuaccauacccucagcacccccacaccuuaacaaaaauaagcaacaaaauaaccuauccaugauaaaacaauaguauuauacuuugcgguuagccugggcacccauaauuccagcuuauucaguucauuucacaguuacuucaucagugcaccacuugccauuaguagaccuguauuuuucuguucugaugccauuggaugggcuuuuguuagggcuuaccuggaagguuuuaguuauuuucaacaucuggaggaagaggucggggguuucuuuuccauccuucccagaagacccuuaugcugauuauaaauucuuuguauugaucuguuucacacaugcacauucacgcacccuccacucgugcucucucucucucucucucacauacauacacgcgugcaaacaaaaugaguuuuauuuuacaggacuucuaaacaauaauaauggugauagugaugaagauagcuaacauuuuugaggauuuauguaugccuaacaugauaaacaauuuauauauauuaucucauuuuuuuccucacuuucaugagauuagcauuauuauccuguuuuuacagauuaggaaauuggggcauagagaggugaaauaauuuguccaaggucaaucaacuaguuagugaagaagucagcauucagaccuaggucuuucugacccaagaaccagggcuuuuggccaggaagcaauucugugcuguaaguauguauuucugugaauuauguuuuguugacauaaaucaugggcuucuugaaucacaguauucuuguauuuucuguuuguuccucauaucuauauuauuuagaccauaacuucuuaaagacucagacauauucuuauuaaacuucuuuguaggaaucagcaaagcauugggcacgcaaauuuuuuauuugaaauaauuuacaguauuguaaaacagauuuuaugggagaaauuugugauauuugaaggcuuuucccccuuaaaauccucaugguuuguauuacagugauuacugacagaauacuuucugucuagcuuuacuguuuuugcccuccuuggcauccauucuagaaugguugcucacuacaagaaaaguuuuaacgaaaugacuguaugauuuaaauauucucaauguauuagaaaucacauaauucaaugugacauuauacagcagccccugcagaaaaaaguuauucccgaggucauucuuaaauucaaaaauuauauuucaauuuauaacauagaaaaggacauauguauaccagaccaguaauuuuauuuagaaauauugugcuggcuuuaaucuguggaguccauuaauauucugcauuucuccuuaugauuuugagacaaugcuaaauuauuuuuaaagauaggguuuuguuuuaaauaucuuagccaucuuucaugcugucuugaggucaaaugagauaguguuuguaaaaguucuuuaagaaaaaacugaaagcuguaugaauuaaaguuaagauuguguaaaguuaagcuaacauuuuucuaguaaagaggugccuguugucaaagggcucugugagcauuuucuguauaauuugucaaagauauauaauaaaccacuuuugaugcuauuauuuuuuuaaauuauaggauuauuuucagaaucuucuacaauuagaauacaugugauuuugauuaaacaaaguuucugcuuacuaugaaaaaaauguacucccccacuucaacccuucaaaucccuaaaacuagcacgaaggcuuuccugacgcuaagagauuuaaaaaucauuuugaaaaaguuaaguuucuugaaagccucugacagaguuuaugguaaucguauaacauucucauuuccauaaaggagcaaccuuaguagguccuaaaguguuggugccuaugggccacacagacuuuccccacguuguggaaauuauccaugacacaaagauucauaugaaaauauaaaauuagggaggaagaauccaaaugguaauuuuuacagauguugauuuucuguagugggaaucuagaggcaauugucuugucauuuaauauuuguggaauuguucuuacccuuugugaaggccaaauucaugugugaagcaucaaugaacuuugaaagaaagguuuauucucaaccugagaagguuagagauuucuguuugaggaaauuauguggaaaacacuuuuugaaaggaacauauauuuuacuugaaauaaaaugaagugugaaaaaaguuuuuuacugagagaaccccauuguugagccaucuaagugaagcucaagacccauuuagagaucuuuuaaaaauuuuguuccuuuugccauaaugaaauauuucccccaugcucugucagagucaguuugauuugcuguguuuuuucuaauuuuaggagcaauuucuacuuaguugacacuuucauuuuuuugucuuaaauuugacauaaucuuaggaaacuucuaaaauaacuagauggcagaauuauuaacucuuaguaguuuuuaaauaucaaggucauauaaagucauacuguugguuugugccauuuaaaaucaauauuggauuuuaacagauacccucucuauacuuaucugccuuauaaauuauauaaaacuuagcuuugcauuugaaugugguuuaacugggaaguguuuaagaaugcaaauauaacauuauuuugaguguuuacuucauauaaguaauuucaugaguguguuagaaccaagucuccauuuaccuauuugcaucauaugaugaugacagaggaucaaauuuuacuuccucuuuacauucaggaguuuuaaauuuugagggaaggacgcauaaauaguucuuacaguagucggggcucugccauuuucucaagcuguagaaaaaucaguacauagaaucacaacugaccuuuauuaagcagcagagaaacuucauguugucucuggauguuucagucauuaaaaucaagaauuugguuccuaauaaugggaguuaacugccaaauugcaugcgguaauccauacacgguuaguaaauuuuuuuaaaacaccacaauguagauaguaucaaacuaccagcauuuuugagguuggugaaaucaaagaggaaaacaagguaccaacccccuuuaguuuuuauagucuucuggaauaaaaacaauucaguugucgaggguuuauaaaguaacuucauauuugucaguuuuuccugccugcaguauuugaaaacuggcaucugagacauuagaaguuuauuuugucaagguuauggaucaugacccaugacacagcccuaggagguccugagagcaugugcccaagguuguuggguuacagcuuggguuauguuuuaggaaacauaaaacaucaacaauacaugugaggcauacauugguucaguccagaaaagccagaaaacuuggaaggggugggaagcuuacaaggucauugguggauucaaauauuuucugauuggcaguuuguugaguuauuaucuaaaggcuuagaaucauagaaagaaguggcuggguuaagauaagggauuguggagaccaagguuauuucuuacauagaugaagucucauggguggcugccucaccagaaacaguagaaggcaaauguuuucuauacagauccuuaaaaggcucuagacucagucucuucgggaucagaaaaagaccuggaucgggaaagguucucuauucucuauaggaaguaaguuuccccuaugagacaguuuugcggggccauuucaaaauaugucaaagaaauacauuuugguggaaaauacuuugguuucuuucagggcccuacucucugccaugugcuguuauacuagagucagguuggaagcuauagagucuguucuguuagucuuagaaucucuguuuuaauguuaaugcuggucagccccgugccugaacucccaaggaaggagaguauaaugaggcaugccugacccaccucccuuccagucauggucugaacuaguuuuucagguuuaguuggguccucuuggccaggaggaggguacauucagcuaguugguggggcaccuagaauuuuauuuuugguuuacacccaaauacuucaaaaaguaaaucuuaaagagagaagaaaggucagugauuuuucagguggguucuucugucugggaaggugcuuagcuuuuaccaagauaguaaaaggauugggaagauuguacacugaguagugaagaaagaagauauuuagauagcuagucauauuaacuaaugcaaccaaugaagagauguaacuuaacaagauauuaugucaaaaagacagggagauuguuaaaaaucaauacaaaaaguuuaggaaguucauuuaaggggggaaaagccagaagauuugacugcugcuucauaauaggaugcugaaauggguaguaaacauaaauaaagguacuccaugcuauuaaucaucagaaaaaugcaaauguaaaccucagugagauaacaccauauacccaucagaauggcuuuaaaaaaaaaaacaccaccaccaaguguuggugaggacguggagcaacaaguaaucucauacauugcugauguaaguuauaaauugugcacacacuuggaaaaaaauuuuucaauaucuacuaaagcugagccuagagguccccucugcucagaugcauauugaaaauuugaagcucucacaaguauugaugucauagguccauucauuuuaauuaagcuguuuagauuauggggacuagaggccaaccuauauucccuugagaaaugggaaaauucccagcaaccaagaaaauuuagaauacgcuaccugcaaggcaaguuggaauuguauacuuaacucaagugcuuuuauuguuaacaaaacuccaaucaccugcccucagcuacaauuaauauaucuguuucauccuauuauuucuuuucucuuuuuuguaauuccuguuuauucauaacuuuugcucuccuauccuauucuuaguuucuguuuccuugguuugucauuuuucugucuuuugauuucaaccccuaacugccuuaaucucuuaguaugucccaaaguaaaagaaaaaagucuaauugccauuucacagcacauuacuaugaauuuguuaauuauuuguuuuuaaagaaaguuuaaaggaagggguaggauuggcaguuauacaaguauaauguucugaaaaugcauuuuaugauuuugcauagaguuuaccagauuuucaaguuuuuauaauguuuacuauguguuugccacuaacaauuuagguuacuguuacuagauuuucagcuuauuucucuauccuuuuuucgucuguaauuuguaaacuauuuagauaacaaguuauaaaaaaagguuaaucuagaguuaaauaacuguuccauauaauucuuacagaagauauuaaagaaaaugagauuacauacugcaaaaguuauuucuguacaaugcccuaaugugguauuuaaauuuuuauuuaaugaagagggaagauuucugacagucacugggacacaugggauucugcuuuuuucuauauuuaauauggaaaaguaauggugggagacauggcuuauacauauugacagcaauauaaacuguuuuccaauuuugcuugcugaguauuaggacauuagcugggagaaaauguuuccuaaagucaacacagaacugcacuuuuucaucaaaucuuuuuaaucacuuaaaaguauuguacuuauauuaucguuauugcuugguacauauucucagcuugucugauacugagaaugaaaaacaacauugggguaggaauaauaaaaauagguagcaaaguaaauuaguaucccgcagguuaaaauauuaccguaacugaaaacaguucuaucauuuuucagucacacaggaaguccauguacuucauaggcaaauaaugauuaagauaggaaugcuuauauugcuguucaguucuuagccccuuguucuuuuuaguaguacuccucugauauauagagggauagaaggaauaauucagcacuuuaauguguuauuuaauucucacagaagccccauuuuacauaaaaaugaaauugaauggauuaugagaauauugauuauugauugguaaguaguaacauuauuuuuucaagaacagcaaccuaaaauacucauacaguuagcucuaacaauguuuacaagucuuaaaacuauuccugcaaauuguuguauuacauaaauguuauugacuccucaaccaugguuuuuuaaaguaauauuuguuaauuauaaaguaagaaaauacaagccgggcaugauggcacaugccuguagucccaucuacuggggaggcugagucaggaggauuguuugagccuggaguuugaggcuacagugagcuaugaucacauuauugcacguuagccuggguaacacaaugagacccugucucuuuaacaaaaaaaaaaaggaggccgggugugguggcucacaccuguuaucccagcacucugggaggcugagguggguggaucacgaggucaggagaucgagaccauccuggcgaacauggugaaacccugucucuacuaaaaguacaaaaaaaagauuagcugggcgugguggugggcaccuguagucccagcuacucgggaggcugaggcgggagaauggcaugaaccugggaggcagagcuugcagugagccaagaucgcgccacugcacucuacccugggcaacagagcgaaacuccgucucaaaaaaauaaaaaauaaauaaauaaauaaauaaauaaauaaauuuuuuuuaaaaaaggaagaaaauauagaaacuaccuucagucuuauaacccagacaacgguauauuuuucucuucuguguaccuuuuccuucaaaaacauuauggauggagauaggauuuggggaagauggcagagcaggaagcacccagaaucugucuccccaccuagacaacaauuacccuagccagauaugucugauauaacuguuuugaaacucuggagucugcuaaaggcuugcaaguuccagggaaggcuugagugguaaauugcuguuaauuucgguuaauuucagcucuuaacacaguaguagcuuccuguaccuccacccaucccagccccguggcaggcagcugugcauguguuccuagagcaauccauacacuugugggagccagagugagcacaaaagauucuguccucuaaauacuagggaucuaugcucugacugcaaguuauggcuucuuaucacagaggugcagaaaaagaggugggugaccauuauuguugcaggucccucccccucuggcuguagugauuucuaggagacuugaagggccaaugcccucuuucuccuuaacuuuucuccuuuuccuuuugggagcgagacauuaaagacuaggacauucauaaacaacugcauauacacaaaaaauuagaaagugaugauugugcaugcucagggaaaggugcagggcuagaaaaaauccgaagaagaccuuaccuuuccaccucaggcuggauccuuggcacagaaauagccuacgacaguaaaaaauaacaauaacaaauaacaaacccugaggaaaaaaaagaaccugauuuccagaguuaccacacuaguaaauucaaaguuccaguuuucaacaaaaaaacacaaggcauagaagaaaacaggaaaauguggcuuuuucaagggaaaaauguagaucaacaggaacugucccugaaaaagacuugauggcugaucuacuagacaaaagacuuuaaagcagcuaccuuaaugauacucaaauaacuaaaggaagauguggggaaaguuaagaaaaagauaaaugaacaaaauagaaauaucaaugaagaaauagaaaaccugaaaagaaaucaaaaagaaauuauggagcuagaaacucuaguaacugaaaugaaaaauucacuagagguauucaaaggcagauuugcacaaacagaacaaucagugaacuuaaauauaggacaacggauaugauuuaguuugaagaacaaaaagaaaagauugaagugaacagagccuaagagaacuaugggacacaucugacagaccucccuauacauuuugagagugccaggagaaaagagaaaggagcagaaagaauauucaaagagauaauggccgaaaacuucccaaauuugaugaaagacaugaauauaaacaugugagaaguuuaaugaacuccaaauaagauaaaaucaaugagauucacagauaaaaucaacuuucaaaagacauacagaguauccugaaagcaaucagaagcagcucaucauauaaaaggaauccucaauauaauuaacagauuucuugucagaaacuuuagaagccagaagguaugggccaauguauucaaagugcuaaaaggaaagaacugucaaccaagaugccuauauuuguggagccaggcaugguggcauugcaccuguaaucucagcuacucaggagguagaggcagguggaucauuuaacaccaggaguuugagaccagcuuuagcaacaucgcaagaccucaucucaguaaaaacccaauccuaugucugacaaaaguguccuucaaaggagaaggagauagcaggugugguggugugugccuguaguccuagcuacuuggaaggcugaggcaggagagucacuugagcccaggaguuuaaguuuagccuggcaaaauagcaaguccuugucucuuaaagaaagaaaaaauuaguuuuucagcaguaaaaugagggaauaaagugagggagaaauuuaaacacgcccaaauaaacaaaagcuaagggaauuagcuuugcuauuugccacuagaccugcacugcaagaaaugcuuaagggaguccucugaagugaaauguaagcauacuggacaauaccucugagcuguaugaagaaauaaaaaucuuaguaaaagugcaugagcaaguauaaaaauuagaauuauuguaauaacaguuuguaauucugcuuuuuguuuucuacaugauuuaagaaaaugauacauguuuaagaacacaauuagucuaaaagcuaauaguauuguaacugguuuguaauugcagauuuuguuuucaguagacuaauggauuuaaaagaauauuugcuuauuuuuuuagucacacagaauauaaagauguaauuuugugacaucaacaacugaaaggggugaagacagagcuucaaaggaguagaguuuuuguauguuacugaaguuaagcuaguuuaaguucacauuacaguguuauaauuucaggauguuaaauaucaucccgaugauaaccacaaaaaaaauagguauagaaauacacaaaaggaaauacgaaaaaaauucaaauauuucacuaugaaaaaucaacuaggcugggugcaguggcucaugccuguaaucccagcacuuuaggaggccgaggcgggcagaucacgaggucaagagaucaagaccacccuggccaacauggugaaacccagucucuacuaaaaauacaaaaauuggcugggcauggucacgugggccuguagucccagcuacuugggaggcugagauaggagaaucucuugaacccaggagguggagguugcagugagccgagauugcaccacugcacucagccuggugacagaaugagacucugucucaaaaaaaaaaaaaaaaaagaaaagaaaagcaaaaucaacuaaacagugauaaacuagacagugaugcaggaaaugagggacaaaaauacuaauaaggcacauagaaaauagcaaaaauaaguaaguucuuccuuaucaguaauuacuuuaaauguaaauggauccaacucuucaauugaaagacugacagaaugaauuaaaaauacaugaucaggccaggcgcaguggcucacauuuguaauuccagcacuuugggaggcugagguggguggaucacaaggucaggaguucaagaccagccuggccaagaugguaaaacuucaucucuacuaaaacuauaaaaauuagcugagcgcaguggcgggugccuguaaucccagcuacucgggaggcugaggcaggagacuugcuugaaccugggcggcagggguugcagugagccaagaucacgccacugcacuccugccugggugacagcaaaaacaaacaaaaaaaaugaucaacuauaugcugucuauaugacacuugagauccaaagacaacaaacagauugaaagugaaagaauggaagaaaauauucaugcaaauagcaaccaaaagagagcaggguuagcuauaguaauaucagagaaaauagacuuuaaguuagagaagguuuuaagagacaaauaaggacauuguguauuaauaaaagguucacugcagcaagaagacuauaacaauuauaaacauaucuaaugacagaccaucaaaauaauaugaaacaaaaacagaauugaaaggagaaauagacaguucuacaauaauaauucaaugcccuuuuucaguaauagaccagacagaauuaaguaaagaaacagagaacuuaacacaauauaccaacuaggucuaaaagacauauacagaacacuguaccaaacuauaauauauacauuuuucucaaguacacaugggacauuuucuagguuagaucauguauuaggacacagauuaaaucuuauuccauuuugaaauaaauaccauauaaaguguccucucugaccacagcugggugacuugagaaauuaguaacaaguaaaacuggaaaauuuacagaaucauggaaguuaaacaacuaguggaucaaagaaaaaauuacaagggaaauuagaaaaugcuuagaguugaauaaaaacauaccaaaacuuugaggauacagugaaagcagugcuaagggagaaauauagccauaaacacuuauauuaguaaacaagaccucaaaucaacaacauagcuuuacaaauuaaaaaggaaaauaauguaaauccaaagcuagcaaaaggaaggaaauaauaaagaugugagcugaaaucaacaaaacgagaauagaaaaacaauagagaaaaucauuggaacuaaaacuugauuauuuaaaaagaucaagaaauuugacaaaccuuuagcuagauggacuaaggaaaaaagaacauucaaauuaccaacaucaggaauuaacguagggauguuauagcaguccuaccuuauucacaaggguauauguuccaagaccccaaguggaugccugaaacaccacagaugguacugagcucuauauguauauauauaaauuuuuuuccuaugcauacauacuuacgauaaaguuuauuuuagaaauuuggcacaguaagagauuaccaccaaugacaaauaauaaaauagaauaauuauaacguauacuauaguaaaaguuacaugaaugugagcacaugugcgugcucacucuggcucuuucucucuuuuccguucucucccccuauuucccccucccucucuccuuucaaaauguguuacugugcuauacucaccuauuuuuggaucagaauuuccacaaguaacugaaucuaugcacaugaaaccagggaaaagaggggauuacuguacuacugacuauagaaaauaaaaagaaguguaagacauuaugaaaaauuuuaugcccuaaaaucggguaaccuagaugaaauggacaaauuccuagaaacacaacacugaccaagacuaaaucagaaaggcugggcacaguggcucuugccuguaaucccagcacuuugggaggcaguggcagguggauugcuugaacccaggacuuuaagaccagacugggcaacauaaugagaccccaugucuacaaaaaauacaaaaauuagcuggacgugguggugugcaccuguagucccagcugcuugagagcugagcugugaguauugcuugagccugggaggcagagguugcaaugagcugagauuacuagaccugcacugcaagaaaugcuuaagggaguccucugaagugaaauguaagcauacuggacaauaucucuaaguuguaugaagaaauaaaaaucuuaguaaaagucaaugcaugagcaauuauaaaaauugcucuccagccugagugacagagucaaauuaauaguauaaugagauaccaccuuaaacccauuaggguggcuauuaucaaauaaauaacaaguguuggcaaagaugugaagaaauuggaacccuugugcccuguugauaggaauguaaaauaguacagccagugugaaaaauaguauggcaauuccucaaaaaaugaaaaauggaauuaacauaugaucuaccacuucuggguauuuacccaaaagaaaugaaagagggaucuugaagagaguuguauacccguguuccugguaugauucacaaucacaaaaacauggaagcaaccuauguguacauagauggacaaauauauaagcaaaaugugguauauccauucaauggaauaucacucaaccuuuaaaaagaaggaaauucugccacaugcuacugaagcgugaggacacuaugcuaagugaagccagucaccaaaagauaaauacuguaugauuccacucauauugggugcauagaguagucaaauucauagagacagaaaguagaauggugauugccagggauagggggagggaaaaaugggauguugcuguuuaauggguauagaguuucaguuuuguaagcugaaaaaguuuuggagauuaauuguauaauaaaguggauauacuuaccacuacugaacuguacucuuaaugguuaagauaguuucacuguuucaaaacauguaguguauccuuauaacaaauacccacguucuuaacaauagagaugcauucugagaaaugcauaguuugucgauuuuguugugcaaacaucauagagugaacuuauguauagaugguauagucuauuacacacuuaggcuauaugauagagcauauugcuucuagguuacaaaccuguauaacaugcuauuguacugaauauuguaggcaguugugacacaauaguaauuauuuguaugucaaaacauagaaaagguacaauaaaaauaugguauuauaauccuauggaaccaccaucauauauguggucugucauugacaaaaacauuaugcagugcaugacuguacauacuagaacaaaacacuuuuauaccaauacuguugugacacauuuuaaauauuggauacuaaaugaauauagaggcugauaguugaguguaauuguauuucuaccucuaccaagaccuuauuagcaaugcauggacuugauccuaagagaaacagggagccauagauacagguauaugauauuauguaaucaaaagcccugaauuacaaguguaagaaaagaagguugaaaccaagcagagaaugggggcagcuguuauggcccucuacuucuaugguaccauguuauauuugggcauuuuuuuuuacuuuggauggucauaagcaaugucuuacucucuucuuccucucuaguauacuuguaacacucagcuuuuuagcccugaguuagguaagucauugcuuaagacacaggaacuaggguguaugauaggcccugguuaauuuuuccagcuucaugucacuuuagcauuuugccuauucagauauuucuguaaaggaaaguuuaucgcauguucuaguuuaguagaagaaaaugccaaaugaauaaccagcucccauaaaugaccuucaaaugaguugcuauauuugauauuaguuuuuaaauuaugauacaggaaugacuaggauuugaaaaagcucucccguggugguuugugggcaaauuuuugcaaauguucugauuuucagcgugauuugagaaaaguaucuugaggguaagcaaauaggguauucagugaaguuaauuguacuguaccuagguuuuagaccauugaaauaugauaaaaauccuguuuaauacuauuagaaaauaaauguuuuaaaauuuauuugauucaugauugguucaguuccuggaaauuauugucaguugagccuuuucuuauaaaguuaguuuucuuucauaucucuccaucugguucagcaagggacugucuuauuugguuucuacuguauauguacauuuucagucugagucuugguauuuagguuuaguauagagaauuacacuucuggacuaaccauaucguuuuacagauaaaaugaagcccagggaaggcaauaaguaaugugucuaauugucuguuacagugauucaaaagcacauuuucucacucauguucuugugggguuuuugcuacagacuauaacuucucuagugggggacccauaaguauuugaaagccuaaauaaauuuuaauauuaaugagcaugaaauugucaugcuaaauuuuaccucagauaauauauuuauauugaccuggacaagcuaaaauuguucccauugcguauuuuaaauuacaauuuuauugauuaaauugcugucuuagguauuguaucuggcuccucaugugguuuguuuuaaaauaguaauauugaaguuaaauguauggaugcucacaacacagucagcuuguuugauuuuauuacggguuucagaauuuuauuuucagaaaaauccuuuauugugcuuauguuaacauuuaaucuuguauuuucucauuuuccauaauuaaaauggagagagacaauguaguuuagguggagggagugggagugaggaacugugacauuaacagcuagguaauuuuugacaccaugaggaaguuacuuaauuucucucucaauuucuuugcugugcuucuugcuacagaguguuauuaggaaaaagaagaagguuuucaaaaggcaagugcuauuuuuuuuuuaaagccaaccuuuuuacuauguuuuauaccacuuucuuuggaggguagauagacugaugaacaaacuguucagaaugauaauguacgaguuuaucuuccacauaauuaaaccaagcuaccaaauuuagcugcaacuuuaagagagguuuuuuggcuuuuuuuuuuuguucaauucaguuuuuagacauuucugguauuuuauuuaaucgauaacuuugaacuauauuauuuaauuugaaaugcuuuuaaauguucucaaagcaucaaagucuaaagcauaaagguauauauauauuggauuuagucuaaagguuacuauuuuuuuuugaccaguaguaaccuucguaucagcuuucacaucgaaaaauauuacugaccuccucuaguggccaaaagauuguuaauuuaaaaacauguucaggcugguauugcucuuaaaagaaaaaaaaaaagauauguccuaauauaacaaagguauggucucauuacuguaguauucagaaguaguaaaccuugaucuggguaggagguguuucaguaagugcuucauugacccaagauguuauuuuuuauuuauguagaacaugcuuaggaauacugcuuacaaauacuaacaaauuugggaagcaguuuuuuugcaaaaaauuuguaugagggaucuuaaagcaaauauguugaaauggaaaaauacuccuauaguaacuauauuugaauuccagauuauuaauuuugguagaauuuauguuuucaaaauaauggauuggugauuagagguuguaaaugaguucaccuucuuuuuucuuguggaagaguaaguggaauuaagaaaaagccaguaugccuuuaaaguacuguccccaaaacuggugccacugggauuuugaaagcauguuacaaauuuuaagaacauuuaacacuguaucaguuaugaccacugaguaauuucuucucauuuucauccuuacuuccuuaacccugcuucacccucaaaaagcagacauuauaaaugcaaauaaaaacuguggguuuucaaaguggauaucuugagaagccaaagagauguguuaacaaauuuuuaucaguuuuuuagaacaguuugauaacuuuucuuuuagaacuacuuuuggucccuauaguacuuuuuaaagguacugauaucuuugaugauagauacgauuuuugagagaaauuaaaaacuaauugagagccaugucauauaaauaaaaucaauuuaagaauuuaagcucuuccuuuaauauaaugagucuuuucuuuaauuuuuauucuaaaaucaccaaaaugauuugaaauagcucuauuuuguguaauaaauugcucucaauaugguuaugauaggaacauucaggaaauuucacacaaugacagcaucauuagcacaauuguagacauuaccagaaugacuaauuuuuaaacaaugaagguguauuuguguguauauuuguauuuguuaaaaacucaaaauuuuuauauuuguaguuauuguaguuacuggcauaaugaacccucauuauuaaauugaauaacaauggaaguaggauucaugaguauacuaucuuuucuuuuuucuuuuuuuuuuuuuuuuuuaaugagacagagucucacucuguugcccaggcuggagugcagugguacaaucccagcuuacugcaaccucugccucccggguucaagcgagucuccugccucagccucccaaguagcugggacaauaggcgugcaccaccacacccagcuaauuuucauauuuuuaguagagacuggguuuugccauauuggccaggcuggucucaaacuccugaccucaaguaauccaccugccuuggccucccaaagugcugggauuacaggcgugagccaucaugccuggccuguuuucuuuuucauuggaauuauuuauacaguauauaaugaaacuuauuuaaaugaaauuuuauuagacuuagaaguacaaguguacuaaacucguagccuccacauuuaucuguuacccaucacuuaaaauguguugcaucgauuuugcugaaauggagucuuguuuuaucaugucuuuguuguaagaugauguuacuuguuuugaaauaguggaacuugaagaaauacauaagggcacaagacauauagugaagacaccguuaguaaaguguuuaauguuuauauuuuguuuuaagaucauuuuaaaaaaucaguaguuuugacuugcucuguuuaagacucauuaauacuggacaugaauaggguggauucauuuggauuuaaacuucauacugggccaguuacaguggcuccugccuguaaucccaggacuuugagaggccaagguaggagaaucgcuugaccccaacaguuugagaccagccuagacaacguaauaagaccccgucuuuaaaaaaguaaaaaauaaaaauaaauuaguggggcaucuuugcugcaugccauuagucccagcaugcagcauacuugggaggcugagaugggaggauugucugagccugugagaucgaggcuccugcaagccaugacugccacugcacuccagccuggguaacagagcgauacccugucucaaaagaaaaaacauauauauucaaacuguugaguuuugaauauuuucaaauaaauguccaaaauguguuuaauauuauaaaauauggauuauaaguuguaggggguauuauuauauuucaaaagacauuccaauuuugcuuagaaaugaaucacacauagguaucuaaguaacuucugaaauaccuuauauuuucaucuguuacagagagauucuuauuuuuaauugcagucucccauauuuaaaucuagcaaaagaaagaaaggaaagggaaagggaaggaaaaggaaaccuuuaccaaaaccaguauaagaaauagaguacuacacuuacaaagcuagcauugugucucagaaaagaagaaacuagagccauuuuagguaaaggaccuaacaugauaccuuugcucuaggauuuuaauacaccucauucuuucauaagaauuuuccacacagguggccgagugcaguggcucacgccuguaaucccagcacuuagggaggccgaggcgggcagaucaugaggucaggagaucgagaccauccuggcuaacacggugaaacucugucucuacuaaaaauacaaaaaaauuagccaggcaugguagcggacgucuguagucccagcuacucgggaggccgaggcagaagaauggcgugaacccgggagguggagcuugcagugcgccaagaucgcaccgcugcacuccagccugugugacagagcgauccuccgucucaaaaaaaauaaaauaauuuuucacacagggaccugccgcugccccagcuggcaugcaugcaugcacagaccccuauagguacacaaauauaugaggacaccugcagguacccugcuggugugcacaugagcaaggacccccacugccccaccugugcauaugugcagggugagggagccaccaccacccuaccagagugcuuuugccagcaguccccaucagaguguuuuuaccagcagacugggaaugccuuaucccuccaguacagcaggugcuuaaccucuaggggccagacaguaauccuggucucagccccccaggauuagaacacaucgcuaaggagugcugaacuaagccuuggcccccuuaaaguguccagaaacgaaaccaaucaacuaaacccaacuuacaccacagucaauuccuuaagagccucaaacaauauaaaaaaagaaagcccuauccaaaagacagcagcuucaaagauuaaaggaacaccagcccacagaguugagaaagaauuagcacaagaagucuagcaacucuaaaagucagugucugcuaaccuccaaauuaccaccuagcuccccagcaauggcucugaagcagacugaaauggcuaaaaugauagcuacagaauucagaaucuggauggcaaggcagcuccuugacaaacaagagaagguugaaaugcaguccaaggaacacaguuaaacaguccaaggguugaaagaugacauagccauuuuaggaaagaaccaaacagaacuucuggaaaugaaaaauucaccacaggaauuucagaacacaguggaaguauuaauagcagaaaagaccaagcugaagaaagaaucucauagcuugaagaccacuccuuugaaucagugcagacagacagaaauaaaagagauagaauuuuaaauaaugaacaaaaccuccaaaaaauaugccuacaucaagaacuuagaaugaucacaaauuuacaaccuaacaucaccaugaugaacuagaaaaacaagaccaaccccaaagccagcaggauaaaucaaauaaaaugagagcugaucugaaugaaacugagacauguaaucugugcagaaaaucaacaaaaugaaaacuugguucuuuggaaaaauaagauugauagacuucuagcuagacuacuaaugaaaaaaagaagauccaaauaaacacacuuagaaaugacaaaggugacauuaccacucaucccacagaaauacaaaaaacccucagagauuaaaaaccucugugcacaaaaacuacaaaaccuagaaauaggugaauuccuggaaacauaaaaccuuccaagguuugaccaggaaguaaaugaaauccugaacagaccaauaacaaguucagaaauggaaucaguaauuaaaaaaaaaaaaaccuaccaaucagaaaaagccguggaccacauggauucauagcucuauucuaccagauguauaaagaagaauugguaccaaugcuacugaaauuauuccggaaaaaauuaaggaguacauauuccucccuaacucauucugaggccagcaucauucuuauaccaaaaccuggcagagacacaacaaaaaacuucaagccaauaucccugauaaacugagaugcaaaaauccucagcaaaauauuagcaaauugaauacagcagcacgucaaaacaccaccacaaucaaguaggcuuuauuccuggaauguaagguuguuucaccauaugcaaaucaauaaaugugauucaucagauaaacagaacuagaaaugaaaaacacaugaucaucucaguggauaacaggaaaggccuuagauuaaacaucccuucaugauaaaaaaaaaaaaaaaaaaaccucaacaaacuaggcauugaaggaacauaccucaaaacaauauaagccaucuuugacaaacucacagccgauguaauacugaacaggcaaaagcuggaaguacccccugugauaaccaggaaaagacaaggauguccacucucaccacuccuauugaacauaaugcuggaagcucuuagccagaacgauaagucaagagaaggaaauaaaaggcaucuggauuggaaaagaggaagucagacuaucuucacagauaauaaauauuauucuauuccuagaaaaccccauagucucugcccaaaggcuccuagaaccaauaaacaaauucaggguauaauaucaauguacaaaaaucaguaccacaagccaagcaccauggcucaugccuguaaucccagccccuugggaagcugaagcagaaggaucacuugagaccaggaguuggagacuagacugggcaaaaagagugagaccccaucucuacaacaaaucaaaaaauuaccuggguguaguggcaugcacuuguagucccagcuacuuuggaggcugaggcaggaggaccacuggagccuaggagguugaggcuucagugagccaugaucacaccacugcacuccagccugggugacagcacgagacccuaucucgauaaaacaaaaucaguaccauuucuauacaccaauaacauccaagcugagagucagaucaggaaugcagucccauucacaguaaccacaaaaggaauuaaauaccuaggaauacagcuaaccagguaaguguuaaagaucucuacaaugagaauuauaaaacacugcugaaggaaauuggagaugacacaaacaaauggaaaaacauuccgugcuuauggauaggaagaaucaauauuguuaaaacugcuguaaugcccaaagcaguuuacagauucauugccauuucuaucaaacuacuaaugucuuuuuucacagaauuagaaaaaacuauuuuaaaauucauaugguaccaauaaaggucccaaauagaacaauccucagcaaaaagaacaaagcuggagguaucacacuaccuaauuuuaaacuguauuacaaugcuacaguaacaaaacagcauaguacugguacaaaaacagacacaugaccaguggaauagguuagauaacccagaaauaaagccucacaaccacaaccaucuguucuucgaaaaaguugacaaaaauaagcaauagggaaaaggcucccuauuuaauacauggugcuaguauaccaggcuagccauaugcagaagauugaaacuggaugccuuccucucaccuuguacaaaaauuaacucaagauggauuaaagacauaaauguaaguucuaaaacuauaaaaacccaaguaggaaaucuaggacauacuggucuaggcauaggccuuggugaagauuucaugaagaagucuccaaaagcaauugcaacaaaaacaaaaauugacaagugaaaccuaauuauagagcuuuugcaaagcaagagaaacuaucaacagaguaaacagacaacauacagaaagagagaaaguauuugccaacuaugcauacaacaaaggucugauauccagaauauaaggaacuuaaaucaagcaaaaccuaaacaaccccauuaaacgaugggcaaaggacaugaacagacacuucucaaaagacauccaugcugccaucaagcaugugaaaaaguguucaacaucacuguuuguuagauaaauguaaaucagaaccaucucaccaaucagaaugucuguuacaacaaauucagaaaauaacagauguuggugagguugcagagaaaagggaaugcuuggccgggcgugguggcucaugccuguaaucccaguacuuugggaggccaaggcaggcggauuacgacgucagagaucgagaccauccuggcuaacauggcaaaacccugucucuacuaaaaauacaaaaacaaaauuagccgggugugguggcuagcgccuguagucccagcuauucaggaggcugaggcgagagaauggcaugaacccuggagguggagcuugcagugaguugagaucgcgccacugcauugcagccugggugacagagcaagucuucaucucaaaaaaaaaaaagggggggggaauguuuauacacugcuggugggaacguaaauuaguucagccacuguggaauguaguuuggugauuucucaaacaacuuaaaacagaacuaccauuugaccagcaaucucauuacuguguauauacccauaggaauauaaaucauuccuccauaaagaccacaugcauguguauguucaucacaacauuuuucacaauagcaaaaacauggaaugaaccuaaaugcccaucaacaguagacuggauaaauaaaauguggcauauauaccccauggaauacuacacagccauaaaaaggagugagaucauguccuuugcagccacauggauggaacugguggccauuauccuuaguaaacuaaugcaggaucagaaaaacaaauacugcauguuuucauuuauaagugagagcgaaauaaugagaacacaugggccaaaucauggagcuuaucuaauaauuuauguccaacauuagcucuaauuaguucauuuccaaccccauaacacagagaagggaucaggugggugaugccaacaguuccugccaugacagagcucacauagcagggccacagaagcauuguucauccaaaguguuuccugagcucccucugccugcuggaccaccucuucaguguaguaagucuggaaugggugcuaauucccuucuucaugaaauggaugcaguuagaggccauuauccuaagugaauuaacacaggaacagaaaaccaaauaccacauguucuuacuuaaaagugggagguaaacauucaguacauauggacacaaagagggaaacaauagacacugggcccuacuugaggguggaggaugggaggagggcuagggacaaaaaaauaccugucaggcacuaagcucacguccuaggugaugaaauuauuuuauaccaaacuccagcagcaugcaauuuacccauguaauaaaccuccacauguauugccugaaccuaaaauuaaaauugaaaaacaguaagucuuuuguuuguuugagauagucugucugugucacccagacuggaguacaguggcacaauccuagcucagugcuaucucgaacuucuggaugcaagggauccuccugccucggccuuccaaguaacugagacuacaggagcacaccacaaugccccacuaacuuuuaaaaacuuuuuuuguagagauggugucucgcuuuauugcucaggcuggucuugaacuccugggauuaagcaguucuccugccuuggccuccagagugcugggauuacaggugugagccacugcaccuaaucaagaacucuuuuuuuuuuugugaacugauugcuguaauuagaauuccauuuugcugugauucuguuauguugaaacaagcuuacauuuuuuucuuuaucaacuuuauugggguacaauuuacauuuacauucuuaaaaaguacccauuuuaauuguacaguuucaguuuugacagauguagucuacacuucccacauuuucuucuaccucuuuguauucagugcccccauuguacucuggccugcucuuguuugucauagauuaguuuugucuuuuuuaaaaaucaguuuucuugaggcauaauuugcauaccaugaaguacaugcuuuugauuaccuuuucauuaaucauuuuccuggcuccagaauguuuauauuccuucaucacuaagacauugcuuugagauguggauucauguaagucucggagaagagcuuugauuccaccuugucuuaaaauuauguguaauuuguuagccaauuaagaguugagaacauauugaaguacuuuuuauagauagaauguuuuauaagcaagcauuauuaaaaagugugaccauuuuacuuuggcaacugguagguguuagaaguuugaaauuuaagaggcuacuuguuuucauauggauaaauuccuagugucugccugaaaauguccauuucuuuuuucaugaacuguuacuuugguuacagauuccuuuccuccucucgucauccucuuucuuuuuuuuuuccauuuugaccagauccaucaucugauuauugauguuggggguggggacaaguuuccuccuccuuugagauuguuacuguuguaccuucagagaauugucccucuuuguugcuguuccuugccauuguuacuaccacuucuaaucucuacuauucuuuuuacccuugcuuuuuuuuuuuuuuucauuuuuucuuauauuuggaugaacuuaucuaguuucugauagcuuuucagcacuuaacacugccaggaaccaaacuuuauggugaccaugggcucuuaacuguuucaagguaauauagaggacggcaggcuauuuuugauuuacuugcuuguuuaagagacagggucuucuugcucugucaccuaggcuucaguauaggggugcguuuagagcuuacugcagccauaaacuccucgccucaagugauucuucugccucagucucucaaguagcugggacuagaggcacaagccaccacacugguccagggcaggagguuuaaagaauuccaggauauuuugggcaggcaggguggcucacgccuauaagcccagcacuuugggaagccgaggcagguggaucaccugacguuaggaguuugaagacuagccuggccaacauaaugaaaccccgucucuacuaaaaauacaaaaauuaucuggacaugguggcacacgccugugaucccagcuaccagggaggcugaggcaggagaaucauuugaacccaggagacagagguggcagugagccgagauugugccacugcacuccagccugggcaagagacagugagacucugucucaaaauaauaauaauaauaauuauuauuauuauuauuauuauucaguuucuauuuagagguuuucaaaaucccagauaaccugaauuuuauguacuguaggcuggagguggaaguagggguagggauguuuuuugacaaaaagaccauuaaucugagaagcggaaaauccagagauuacuauaagauccuagauggcuaaaacauugaauuucugucacuuaguguaaaguaggauuuagaaacauuuauggauaaagauaauaaagaugggggauuauuugauaagaaacaaaauguaauuaucauacaaauguaaagccaaucuaccuugaagagauaauaggacacaagggaagauuuuuggaaugugcuuuguucuuuaaguuuagguaccaucaguucuuuugcaacuuuaaaugaauuuaagguuaaugaauuaacaguuugguuuuaaaacccaaucuagguuaaugacagcuuguuucuuucuuuguguugauuauaaucuuugccucuuguaaauauuuuuuuuuuuuuuuugagacagagucucgcucuuucacccaugucagacugcaguggcgcaaucucagcucacugcaagcuccgccucccagguucaugccauucuccugccucagccucccgaguagcugggacuacaggcgcccgccacugcgcccugcuaauuuuguguauuuuuaguagagacaggguuucaccguguuagccaggauggucucaaucuuuugaccucaugauccgcccgccuuggccuaccaaagugcugggauuacaggcgugagccaccgcacccggccaacuauuuuuuaaaauuaauguguguucagagucuccucuuuucuuuguaaauuugcuuccauuuuauugcaaauugcacguuuuuuuugauugggugccaccauuccaggagcuccgagauccuagaauauuaaaguuaagguaaaugaagugauacuaacuggaaaauguuuuaaacuagugcuaauaucauuuacauaaaaauaaacauaaaacuuuuauuuauuaauuaaaccauagaagcuuaguauucuuauagcuaaaaagaauauuuuccaauuagaauaauaucauggguaaaccaauagcuauauagaaauguaauagauuuucaggaauuagaccacagaggcuauaaaaugucaauggauauauuuucuauaacacauuguauauaauuuuguuuccuaauauuaaucuugaaauguuuguaacuuuaaauaauuuuucauuguaaccauagguuugauacuaaaaauaauuagauauuauuuuaccacuuguuuauugaguagaauuaaaauuaaauacaauguagcuuuuuguuccuuuguuuucacuguugaucucuaaguauuaaaaaaaaauugauguuuacuaaaccuacagguuuguuuucaccauucaaaugaagaaaagcuguucaauauaaauacuuaccuagaaccauaauaguacagaggagcaggauugaaaucagucaaaccaugauagauaugauauauugucaaaggauauaauacagaugccuugguuuuuccacacaagcauauuaauucacuguacuuuuuugagacuugaguuuuacugugucacccaggcuggagugagugcaguggcguaaucucggcucacugcaaccucugcuucccagguucaggcgauucuccugccucagccuucugaguagccgggauuacaggugcccgccaccaugcccggcuaauuuuuguauuuuuaguagagacaggguuucaccauauuggccaggcuggucucagacuccuuaccucaagugauccacccaccuuggccucccaaaguucugggauuacaggcaugccugagccaccgcgccuggccuaauucaccguacuuuuaaaaaguaacaguagaaaauaaucagagauccaaaauaccugguuuuaguuacuuggaaguucaaauguuuuaauuucuuugucuauauuguuauauugcauuuguauuagagaagguaagauauaaaauuuaugcucugaagaguaucauccccaucaguuaucuuccaugggaugcugacuuaacagacuagcaaaauuggaaacuucgugccaugaacugucgaggugguuacaaaaauuuaaaagauacaagcugcuuccagaaagauccaaguccaguaguaauaacaaaacacaaacuauugugaaugguaaaugcuguaauugugauguguuaagaaugggugagaauacauaaaauuaccauuuugaccacuguuaaguguacaguucugugguauuaaguacauucacacuauuguucaaccgucaccaucauccaucuucagagcuuuuuuaucuuccccagcugaaacucuguguccauuaaauaauaacuacccauucuucuuuucccugccccugguaacaacuauucugcuuucugucuaugaauuugacuacuuuaguuuuccuauuauuaaacagucuuugugaccacuagcccagcacauaguagguauucaauaaauuucuaaauuaaauggcauuuaggaauugaaaggcauugcuuaugucaguggauugacuauauaucuuaugugcacccagacugccaauuguuauaauaaccuuguuaauucauaggaaaccuuuuguuuucucaaguauuuuuuauuuaaauucuuuucacauaguuuacuuuuuuuuuuagacugaaucuggauauggaucugaauccagcuugcgucgacauggcucaauggugucccuggugucuggagcaaguggcuacucugcaacauccaccucuucauucaagguguguaguuaauggaugccuuaaguuaaacaacauaaauugaguuuaguauuggauguugugaacagaacauaugugauaauuuuuugaacaaacuuuuuuauaguauaauuuauuugaaguuauuagagaaguacuuuuuaagguauaaaauaauaacucauauagaugaacacaugucacugauuuuauuucauucauucauuaaugagguaaaauauaaaaaaacugguucaaaggaaaaucugaagaauacugaaaugauuugugaauaugggaaaaacuggucaguauccacagauuaauaaucagugcuucugcaccagacaaaauucauuugcaucucuaugaacaagaauuauuuauacuacucaguuuuuuacuaaaagaguuguaaaauagcucaaaugcagugaaaggcaaaagugucuauaugaucaaauaguacucucccaaggguaccauaaaugacagcucaccauuacuuugaaaggacacaaguaauauuuuuucccauuucaaagucuuucacaguuguuccacacaauuuuguuuaauuugaaaauaccaaauguuauauuugcaaacugucagguauuacugcuuucuuguuuucuauaaaaaauagggcuuauuuauaagugauaucacgagguuaucaucauucauaaguggcuuaucgcuaucaagccaauagauucaucaguuucaagccuauuccuagaaguauuauauugaacuagacagcucuccuuaucccaugcccucaguuauaaggugcagaccuuaaaaguugaugaaauaccauaggaccacaugaaauccaguuuuguuuuacuugaauuacaucccccuauuuuauguuuugcagaaaggccacaguuuacgugagaaguuggcugaaauggaaacauuuagagacaucuuauguagacaaguugacacgcuacagaaguacuuugaugccugugcugaugcugucucuaaggaugaacuucaaagggauaaagguuaauuaggcuauuaccacuauuuuuacuuggagaaugaauggauuaaaagccucuugaucucaaaggguaaugucuuuaagugauaaagguguuuauagucauuuuuugcugcaaacccccagugaaacagauuucaguguccuuguaacuuggguacuucaguuacacauacuaauucauuuugaucauccauaccagaugccauugaagaccuuuauuuuauuuauuuacuuuuuuguugagacaugguuucauucuaucgcccaggcuggagugcaguggcgcgaucauagcucacugcagccucaaacuucuggccucaagcaauucucccaucucagccacccagguugcuaggacuacaggugugcaucaccacacccagcuaauuuauuuuucuauuuuuuauagagacgggggucucacuauguuggucagguuggucuugaacuccuggccucaagcaaucuucccacuucggccuaccaaaguguugagauuauaggugugagccaccacaccaggcaaagacuuucaaaugauacucuuuauuccauuaaaaaaugauaucuauuaucuugguauuauggaucauuucacauuauuauuaugucugauaaauuuagcccaugaugagucuuagaggagauaaguauauguuaaauccuucagaucugaaaucaaccaguugaucucuuucucuuucucccucucauuucucuuuuucuccccuucucuuuucuuuuugccuuuuccucucucucucuuuuucuuucuuuuuuuuuuugagacagagucucgcucugucaccaggcuggagugcagucgcgugaucucggcucgcugcaaccuccggcucccugguucaagugauuguccugccucagccucccaaguagcugggauuacaggcacgugccaccaugcccagcuaauuuuuguauuuuuaguagagacgggguuuuggccaggauggucuuaaucuccugaccucaugaucugcccgccucggccuuccaaagugcugggauuacaggccugagccaccgcgcucggcccccucucucucucagucucucccuuucucuacccuuuuucucauagaagaagaaucaguaauagaaauggaaguaauaauuguauguacauuuaaaaauaauuuuauugaguucuuauuuaaaagaaacaagauaucuucaauuaacuuuuaguguuagguuuauaguuuaacuuuccuuuguuagucccaaaaauacugcugaugucaacauuguucuucagcuuuuucacuuaauuuauugugauggcaaaaauuaacuacucuaccauuauuaccaaacaggacuaaguucauccccaauauaacuagguggcuugacaugguuucauuucucuuuuuuauuaaauguguuugaucuggauccaaguucuuuuugucuauucuauauucccuuuuucugccuucuuuggaugaaauuuuuuucauauauauauaauuccacuuuaucuccuuuguuagcuucuuagguauaacucgugguuuuguuauuuuaguggcuacuuuaagguuuauaguuugcauauuuaacuuaccacagucugccuucaaguaauauaccacuuuauguguaguaucagaaccuuccaauaauguaguagaauguucauagcucccugugaccuuaaacuccugggcucaagugauccuccugccucaacuuccgaacuggcuaggacuacaggcauacaccgucauaucugguuaauuuuuaaauuuuuuguagagaugaggucucgcuauguggcccaggcuggucuuuaaacuccuggccucaagggauucucccaccucaacugcccaaaguacuagaauuacaggcuugagccauugugccuggccuugaaguucuauuuguuaauauaaaaacuuuuauuaaagguuuugguucguuaaugugugauuuuuuuuuuuuccccucuaaaaauagaaaacaccugaacuucuguuucuccuucauuaaaaaaguauaccuuuuaaucaauuuaaauguuacagauuagcuuuaaacaaaaacaggauacauauagaauaugaugccuuguuuaucuuaaugguccauaccaauagcguauaguauuagaaggacaaaagugaugguggaaaaaguggaaguuggaaugcagugauaaccagguuguguagaugauuugaaaaauaauaauagacauuacacggaaucuuuucugcuacauguuuaaauaaauagcaaauugaagacugauguauuaguuugcuagggcugccauaucaaaguaccacagacuggguggcuuaaacaacagauuuauuuucucacaguucugagauaaagguauuggcaggguugguuucuucugaaggccaugaaggaaaaaccuguuccacgccucucuccuuggcuuauagguagccucccuauaucuucacaucaucaucuuucccuuuguaugugucuguguccaaauuucuucugcauauuguacagucauaguggauuagugcccauccuaaugaccccauguuaacuuaauuacugcuuuacaaaccuugucuccaaauaacagccauauucuaagguacuggagauuaaggacuucaacauaugaauuucugagacacaauucagcccauaacaacugauuucccuacaaauguuauuugugagauacugacugauugauugauccuuugauuuuuauuugauacugggucucccucugucacccaggcuggagugcaguggcacaaucuuggcucacugcaaccuccgccccccaggcccaagcaguccucccaccucagccuucccaaguaguugggacuacagaugugcaccaccaugcccagcuaauuguuguauuuuuuguagagacaggguuuugccauguugcccaggcuugucucaaacuccugagcucaagcagucugcuugccucugccucccaaagugcugggauuacaggcauaagccaccacgcccagccugaaaaagcuauuuugugucuguuuuggagguggaagguuaugguaaagggguaguuugagaggaagauuuaaugugcugguggcugagaaauauuuggguggcaaaaauaaauagaugucuggcugauacuguaaucaucucggggagcuuuaaaaaagaaauaauuguaucauacccuucaccauagucucacuaaaccagaauauucagggguugaggggagagagagagauuaacguuuuguucuuuaaaaguuccuugauagguagauaaucaaaaguuccuugauauguggauacccucucuaguagaaguaugagcuagcauuauaaacaagccuucugaaggcagaaggaaagcacagcagaaaggggaaaacaaauauuguacagaaggcuuuugaguuuuccaagaaaacaacuccuuuaaauugugagaauaggucaaaucuagagcaaaugaaauaucuccugcuucuguagaaaagaaugcaugaagguagaguugaagagugaguaacaaacuguuuuaacuuuucauugauaugaugcaaaaaaguagggaaauuugaaaaggccccgggaaguaaggaucucaaaagguacuugaaggucaucuuuaugggauuaugccaggggacuaauuuaggaauagucguauuauaacuucaacugauggucagcaugauuuuuuaucugaguaugguuuaaaaauaauguaucuaaagacauugcacagcauauuuauugagcauaugagaucuuacucaucuuuguauuuucacugguaaucaagauaugcucauauugaagucuguaggaaugauggaaguggaaaagaaaaagaauugaauauugagaucacagccagguagaaaugaauacaggguauuaauagauaauaguuuaugauuuguaagaguuguuauagaugauugacaacauuuucaagugguuauaaaaaaaugaaauaguccaguaauuagaaaauggcaguacagaagauuuuccauggugauuccuaccauuuaaucaaagaagggaaauaagguaucgaauugggcucugcauccauaaaaaagacagcuaagauagaugagauguuccuuauagagccacggugcuccugauguaaaaagauacaugcaguaaguaagacauuaguuuaaaauguagauuccuucuuuauaaagggaguuccugaaaagauaaaggagccauguaggcugggugcaguggcuuacaccuguaaucccagcauuuugagaggcagaggugggcagauugcuugagcucaggaguuugaaaccggccugggcaacauggcaaaaccucaucucuacaaaaauuagcugggcugguggugugcaccuguguucccagcugcucaaggggcugaguaggauugcuugagccugggagguggagguugcagugagcugagauugugccacugcacuccaggcugggcaacagagccagacccugucucacaaacaagaagaagaagaagccacaaaaagcuugauaaaagcagcaaauaauguugggaacuaagaugcaggaauuugcauuaugaguggaaugcguaguacagagaauuaaagcauguggcguaguagaaaaagggauagcacauagaagaaagagguauguuaaaguagaacaagagagauucuguuuuugucuggaauuagagaaaagggaugccuggauacagauacagccugggaugaaugaaaauugauaucauggucaggagauugagaccggauuccuggcuaacauggucaaaccccgucucuacuaaaaauacaaaaaauuagccaggcaugguggcaggcgccuguagucccagcuacucgggaggcugaggcaggagaauggugugaacccgggagguggagcuugcagugagccgagaucgcgccacugcacuccagccugggcgacagagcaagacuccgccucaaaaaaaaaaaaaacagucgauaucauaucugcaagucauuauauuuuccuugcacaucagaaauaguauauauaagaacucucgccuggguguggucacucacaccuguaaucccagcacauugggaggccgaggugggcggaucaugaggccaggaguuucgaaaccagccuggccaacauagugaaaccccuucucuacuaaaaauacaaaaauauuagcuggcugugguggcacgcaccuguagucccagcuacuugggaggcugagguggaagaauugcuugaaccuaggaggcagagguugcagugagccgagaccaugccauugcacuccagccugggugacagagugagacuccaucuacaaaaaaaaaaaaaagaacaacucuuagaggcaagcuaaggugucuucugcauagaaggcacccuuauaguccuguucagcccuucugguccucuuacagaguggaaauggccccacggaagggagcaagagauaggaagacuacagggugaaauaauucauaacucaguaaccuucccuuacacaaaugagagugaauaugguuuaaaaauaauguaucuaaagacauuccacauauuuggguggcaaaaauaaauagauggcugauacuguaaucaucucggggagcuuuaaaaagaaauaauuguaucauacccuucuccauagucucacuaaaugagaauauucagggguugaggggagagagagagauuaagauuuuguucuuuaaaaguuccuugauagguagauauuuauugagcauaccuugauuaccagugaaaauacaaagaugaguaagacuucauacucagaaucagaauccagaguaaaaugacucaguugaacauaagaauagacauuaauuucuauuucuuuucauccuaauuuccuuaaauauauuuuauuuagugguagaagaugaugaagaugacuuuccuacaacgcguucugauggugacuucuugcauaguaccaacggcaauaaagaaaaguguaaguaauacauuuuuccccucagcuggauaaaauauacuuucagaaguuauguaacaacucacaagaaauaauuaccugauuaauuuuuuaaaaagcaguagaacugguggaauccaagugaaaauaucuuccaaggcaugcagguaaaaaucacauucugacauuauguaauaaugguaacuuuuacauaaggauguccagcugucccagcaucauuugcugaaaagacaauuuuuuucccuugucuuggcaccuucgugaaaaucugauagacuguaaaugcgaggguuuauuucuggauucucaguucuguugaguugauguacgugcguauucuuauuaagaaaauauaagcuuuaaaaaagcuuuauugagauacaauugacauaccauuuaaaguguauaauuugauaaauuuggauauuuucgugaaacuaucaacacaaucaagauaguuaacauuuauaucaccuucaaaaguuuucuccauccccuuugucauuccucucucccccauuccugaauagccacugaucuauuuucugacacuauagauuaguuugcauuuucuauaaucuaauauaaauggagucauacaguauguauucuuuuuuugccuggcuuuuuucuuaguuugagauucaucauuauuguugcauauaucaguaguucaguucuucucauagcucaguaguauuuuauuguauagauauaccauaguuuguguaucuagucauucauugguggacauuugggucgguuacaguuuugacuauuacaaauaaaacugcuaugagcauucauauacaauucuauucauggaaauuuauuguauuuauuuuggguaaauaccuaggaguagaauguucuaaucauauggcggguguggguguguuuaauuuuuaaagaaacugccaaacuguuuuuuaccagccacauaugagagucccaguuccuccauauccccaccaacacuuaauauggucagucuucaaauuucagucauucuaauagguguguagggauaugucauugugguuuuaauuugcauuuccauauuaacuagugauauuaagcaccuuuucauguuuuuauuugccauuuauaucugcucuuuggugaaguguguguucacauuuuuuacucauguugggcuuggugauuauuauuauuauuauuuugagacagaguuucccucuuguuacccaggcuggagugcaguguggugaucucagcucaccgcaaccuccaccucccgguuucaagugauuguccugcuucagccuccugaguagcugggauuacaggcaugcgccaccacacccagcuaauuuuguauuuuuaguggagacgggguuucuccauguuugucaggcuggucucgaacucccagcuucaggugauccgcccgccuuggccucccaaagugcugggauuacaggcgugagccaccgcgcccagccaguguuuauuauuaaugagcuuugagguuacuucauauauucuggauagaagucuuuauuaaauauaugccacacaagauuuucucccaguuuguggcuuaucucuuuauccucuuaacaguguuuucaagagcagaaauuuuacauuuugauuuaaguuucacaauuuguucuuugauggauuauaccuuuacugucauaucucuaaucguuuuuaaagucaaaauugacauuauuucauuuauaauuauucuacuagaaugauuucuuaacuauagaauauuaugauuucuuguuugcaucuuugaguuuuaagauuuuuuguuuaauucaaaagcuaaccaugaauuaaaaugauaaaauugaaacguaaaaggcauugaguuuaagugcauugguccuggauuuaaauuuguauguuuauuuuuaaauuguauauuauuuuauuagauucuuuaguuuaucuucagauuuuuuuuaauucuaggcuuuucaaaauaauaagguaguucuugccauaauuagguccuacucuaagcugucagaauguuauuguuaaaguauugcuccuccuaccauuugauuaauugggugcagcacagcaaauaaauuucaggaaacagaaucuagaaaaaaaggacuugaaaguacauaugcugccacgaagcuucuuugcuuauagagcuuggauaggagauuuuuaaauguuggccuacaggaggaaaauuaaaaucccaaaaccugcucugacuugcuaauuuucuaaacauuuucuaaucuuaaauugugaugaauuauuuccucauuagagauauuuucagugaauaauuuucauuuucaguauuuccacaugugacaccaaaaggaauuaaugguauagacuuuaaaggggaagcgauaacuuuuaaagcaacuacugcuggaauccuugcaacacuuucucauuguauugaacuaaugguuaaacgugaggacagcuggcagaagagacuggauaagguaagacuagguuuuuuuccuuuuaaaaauaaucacauuuaaguuuuacguauuguuugaauauuuaaaacaagcuaacuucuuagggaagaaucuuggguugauagaaauagcagaugauacuacuacucugaagcuuuaugggcauccuaaacucauuugccuaacaagauucaccaauuacuuguuuaguuacuauacaguaugcuuucuugaaagauuuaauauaaaaguuuuugugaugauguuaguaaugcuuuggaauagaaguguugagccauuuaacauuacacaccuuuaggugcaugauguaugaaacugcauuuaaggcauaugaacuaacuuauaugccaauuuacaaaguuaaacauuuacuuauuauaguaauacucauguauuuuuuccauggucagugauaccauuuaacauacauuauguuguuugagcauuugcccuauguucacauuuucccaccuuuguuuaaacugcagcacugauaauauuauaguaugacucuuuaguuucuagugugaagcauggcucaguggauuuguuaaguaggaaaacuucuauuuauaauucagcuuuagaauaauaguaaaauguuagaguugaaacauaccuuaaaguucuaguccaaugccaucauuuuauagaagaaggaauugaggcccagaggcuugucaaaaggugaaaaguaauagaguuagaggcauuuuucucuauucuuuuauauaucagcucuggaugccagauuagacaucagccagaaucauauucauucugaguuauauugcuugcagaguuugaaggccuuugaauuugagcgggacacuaaggaaagcaaugauagcacuauguguuuaggaagguucccauguuuuagaagaaaagagagcuguucagaaugcacaagugcaggugagaguaagccauuuugauuaggaauaugucuucuuuuaaaauagguaaugaaaacauccuuuuaagguauagaaaauuuauuaucauucuggagccaaacuauuauuaucuucaaagauuucaacucuauacucaguguggaucaaauugaauuauuagaagagucccuguucacaaaaaaaaaacaauguauugaaaaacaggacaacucccuaaauacauuagacuaaugguucaagauuaucauucagcuaguccagacuagcuuauuuccaacuuuuuggcaacuuucucucucuuuagucucuuuuuccuucacuaagggaucauauucuuuggucauauacucuaaccacauugccuaaaauaauuuuuuuuaaaccuuugcacauuauauaccacuuccugauuauuuuagcauucaaguuuauuugccauguugaaaaggggagauagauuuuugauugcuuucagcauuguuaaucuuaccaguucucuuucuuuauuggguagcaaugagcagagcaaaccaaagaucugcgggaaaaaaaccacuuuuguugcuucuccaugcaacacucuccaccaaagaacagccagaaaagauggcaggcaguauugguuaaaaucuggacacuacuguguuuuauagucuucuuacagaucuaucugaugucaaauuuuauuaaccuuuuccacuguaauuuuuucucaagguugaaauaacuggaucccaguuacauuuuacauggaauguaaguguguguguauuugcacauguguguacacacaguauguguguguucauauauauauacauaauauaugcaggguauguguguauuuauugguaagcaacucuauucaagaacuuucuaaucuuuuguauguagaguguguguguguguguguguguauauauacacacuaaagacuagaaaguucuuaaauagagaaaguuguuuaucaacaaauacgucuuucagguaauucuuagaauugagaaagaaaguacaaugauaacaauaugguuucacugaaauuguuucauucaggugugugccugcugugugcuugacucuaagcuaggaaugggaaaacagugaugagcaggaaauagucucucaaggggcuuaaaaucuaaugagagcaauuaaauaggugauaauaacagcuauuuaauaauagaauugucuauauuauacuuuuauguagauuuauaaugucaguuccaggauucuuucagcuaauugaaaauacuauuuuguagugaugauuuuuauugguuaccuauaauaauaaugauccuuuccacuguagaagaaguguacuuaauuguuagccagucauguccaggaaaaccaaaaauucuaaaauuaggcaauuaugguuaacaguguuaauaagagauaaccuguucauugaagauacauuuucuuacauuauuagauucacagguguguacuuuuacauacauuuucacuuuccuguaagucuuuaauauuauugcugugcugugcauuuuuguuuuauucauuuaaaauuaauacauaacauacauacaaugaaguguaccaaucuuaaguauacuaccugauuuuuuuuaacguuuguauacaccccuuaaccauagacagaucaagauauauaacuuuucuagcacccuagaagguuccuucaugcuccuuccuauuccauaucauaccaccaccccaagaggugaucauaugguuuuaaccuaugucauuauagauuaguuuugccuguucuggaacaacauacaaauggaaucauacaguauacuuuugagucaggccuucucuuuccuucaacauuugacugugagauucauucauguuguuauauuuaauaguaguuuauucuuuuuuauugcuauacacuauuuuauuguauaacuuuuuauuguaugacuucaauuugcuuaucuauuuuccuguugguggacauuuagauuuuuuucauuuuuuggcuaucaugaaugaaacugcuaugagaguucuuggggcauaucuuuagguauauuucucauaccuuggaguagacuucuugauucauagggguauaugcuuaacuuuaguggauacugaugauuuuccaaagugauuauuucuaccagcaaugggugaggauuccaauuauuuuuaauucuugacagcauuuugguauuguuagggauguguggguguguggguguuguugauguuguucacucuugacuguacuugguauugugugugugugcgucuguguguguguguguguauagguguugguguuguuugauuuuggggacagucuuucuuuuuuugagagacagggucucacuguguuguccaggcugaagugcaaugacuauucacagacacagccauuaguauacuacagccuugaacuccagggcucgggugauccuccugccucagccuccugaaugaccaggacuacaggcacaugccacugcaccuggcuuagucauucugguggaucuguagucccauuuucucuuuaguacacaaaaaucaauuaaugaaaucuuugggucuaaugaacccauugauucauugauuuccacugucuuuaacgcugaugugguauuuagaaguaguuugcuuugugugaguucaguuuagacuuuagccauuaaguucagugauacacugcauaacgacauuuccgucagugauggaccacauauacaacuguggucccauaacaugauaauggagcugaauaauuccuuuugccuagugacaucuugaugauccugacccuguguaggccuaggcuaauguguguguugucucuuaguuuauaacaaaaaaguuuaaaaaguuaaaaaaaauaaauuuuuuaaaaaauagaaaaauguuuguagaauacaguauaaagaaaauauuuuugugcugcuguacaauguuuauguuuuaagauaucuuauuacaaaagacucaaaaaguuuaaaaaauuaaaaaguuuauaaaguaaaaguuacaguaagcuaagguuguuauugaaggaagaacauuuuuaaauaaauguaguguagccuaaguaugcaguguuaaaaguuuacaguggugugcaguaauguccuacgccuucacauucauugacuacucacucacucacucacccugaggaacuucaaauccugcaagcuccauucauaagugcccugugcaaguauacuguuuuuuaucuuuuauaucauauuuuuccugucccuuuucuauguuuagauucacaaauacuuaaccaucauguuaaaauugccuucaguauucagugcagucauauguuguaaauguuuauagccuagauguguaguaggcuauaccaucuagguuuauauaaguacacucuaugauguuuauacaagaauuaagucgucagugacacauuucucagacuguauccccauggugaacuaacaugugacaguaaauacauguggcuuucacuagccuucuuuagaucacaagcauaaucuguucucuuaugauuuuugaugaucacgcucuucagaguaguguuuuuuugggaauaaggggaaauaggaagagcuguuuacauuuccuguagccagagugaccaugaauccugguuugaccaaggcaguucuuaauucagcaagauuauuacuaacauucccuuucgcuuucaaaaguguggugcuuacauuacccaauagggggaccaagcaaaucagucuuuuagaaaauggaauuuggacaagguaaaaaaaagaaagaaaagaaaaaagccauguaugacuauuugaaaugaggaaauaaaagcauuagauuauuuacaaacauacuggacuccaguaucaguuuugacccagugaaccccauuguuguggaaauaaguuuuauaugggaccaaccuuuguuauuuuaaguguugacccugggucuuuuaaccuuuuagagcuauaggcccuaucauuaaaaggagaguguuaaaauacauaacuaaagucuuuuucaacgcuaaaauacagucuuaagcagcagugagaaaguauaagaagguuuucuuucuuagaauaucuuuuuagcauucauugaucccaccuacugaguucuuuucugguauuacuugcuguuuuucuucauaccaaaauaaauguaucucuuaacugggguuggugggaaggggaaguauaagaauguauaguagguauuuuucaggugcuaauuuaccuggguuuuuuucuuuucuuuucuuuuuaaguauacaugcaguuacuuaaccauuuaaacacauaaccuacuuuuaaggugauuuuaguggugauuuaaaucguagguuguggccgggugcaguggcucacaccuguaaucccagcacuuugggaggcugaggaggguggaucacgaggugaggaguucgagaaaagccugacaaacauagugaaaccccaucucuacuaaaaauaccaaaauuagcugggugugauggcacaagccuguaaucccagcuacuugggaggcugaggcaggagaauugcuugaacccaggaggcggagguugcagugagccgagaccaugccauugcacuccagccugggugacagagcaagacuccgucucaaaaaauacauacauacauacauacauaaauaguagguuguaaguaauuuauagccuagagaaaaguguuuucuugggcagaauaauacucuuauuuuucacaggaguggaauuuuuuugugucaaauuguaaaauuucagugaaauguagaggaauuccaccuaaaagacuucauuguaauuaaaaugccugccucaaauuacagauuuuucacuucuuuuuaauaggaaacugagaagaaaagaagaacagaggaagcauauaaaaaugcaaugacagaacuuaagaaaaaaucccacuuuggaggaccagauuaugaaguaugaauuuauauuuugaucuuagagaaacacauagaucaugucuaucacaaaagugauuuuuuaauaauacucuuguaaccuuuaaauauucuaaauauauaauuuuuuccucaguguuuauguuaauucaguguauauuucaugauauauaaaugccaggcaugcucaaauauauauuucuuauugccuacaaaguuuaggcuucaaaaggcuuaguauuaggccuguucacuugauaggacaaauuuuuaucuccccuguaaagaugaucauuuuuaauguuaucuacuuuuuuuuuuuuuuuaacauaaaagcaaacuauaaaggaaaaaucugaguacuuugcagacaaaaagauuuuagucuguacuauacugugagaucuuuuuuuuuuuuuugagaccgagucucgcugugucacccaggcuggagugcaguggcgcgaucucggcucacugcaagcuccgccucccggguucacgccauucuccugccucagcugcccuaguagcugggacuacaggcacccgccaccacgccuggcuaauuuuuuuguauuuuuaguagagacgggguuucaccauguuagccaggauggucucgaucuccugaccucgugauccgcccgccucagccucccaaagugcuggcauuacaggcgugagccaccccgcccggccuacugugagaucuuauccauagcugaacauaaaacuguucuaauugucuuuguuugaaaaugucugaaaccagcuuuuuucuccuuguguuuauuuguuaagcagguaauaaaaucuccuucacauguauauacacacauacauuaaaaucuuauaagcuuucuauauuaagagaaaaaaauguguaagaaauauauuugguaauugccauuaaacaauguugaggcuagcgcacuggcucacaucuguaaucccagcacuuugagaggccaaggcaggaggauugcuugaggccaggaguucaagaccaaccuggacagcauagcaagacuucaucucuauaaaauaaaauaacaaaaauuaucuggguauaguggcacaugccuguagucccagcuacugaggagcccaagacugcagugagcuacgauugcaccacuccacuccaggcugggugacagagcgagacuuugucucuuuaaaaaaaaaaaaaaaacguguuggccagcacggugguucacaccuguaaucucagcacuuugggaggcugaggcggggggaucacaaggucaagagcucgagaccagccuggccaauauggugaaaccccgucucuacuaaaaaaaugcaaaaauuagccgggcgugguugugagugccuguugucccagcuacucgggaggcugaggcaggagaaucacuugaacccgggaggcagagguugcagugagcugagaucgugccacugcgcuccagccugggcaacagagcgagacuccgucucaaaaaaaaaaguguugauauuucugaaaugagcaguuuaaaaaugggguaucaaggaguaccacugagguggaacagaagaauaaaauaguuguaguuauauuuaugaaaacagaagaauuuuuucuugcuacuuuugcucuagaaaggaaaacuaaacagcugcucugcuguugcugaauuuuuuugcauuggaaucaauuuccaacugugagagugcauucugaugagacuuaaauuguaauauuuuuaaauuauucucaauuuaucccuucuaaaauguauuaaaauuacauaauuagcuauccucugagguuuuaauaugagguauuauaaugaugauuuuuguuuugaaacuaaacaaauuauuuugcuauuuuagaauuauuauuuuggaagaaauaccaacuuuuuaaaguaccuuauuuuuuaauauuauaaauaaaauguauauucauuauaggaagauuguacaaaaauucaaauaagccaauaaagcccauguuuuaaauuuaacaauauaugguacaguuuaucaucuaccagcaguauguaaguauaauuuguguacauauuuaucucugcuuccaucaacacagguuuuguuuuuuuuuuccuagggguagaggacagggguggagggaagaggggccuugugcuagguacaugcauuuacuaguuucaaagccaaaaaauugcuuuauguauguaauugagcauuuuaaaaauuauguuuaucagauauucauguuucuuuuuuuuuuauuuuauuuuacauuggaaguacacaugcauguuuguuacaugaguauauuguguacuggcagagauugggcuucuagugugccccuuacccaaauagugaacauuauaccaaauagcuaauuuuuuaacucucaccccucccucccaaccuuccuccuuuuagagucccuacauuuccaucuuuaugucuguguguaccuauuauuuagcucccacucauaaaugagaacaugcaguauuugacuuucuguuugugaguuaauuuguucugggaccaaacugagguucgggcugcuauuucucacggcccaauaacgagaugcagaugaacuggggaggaagagaguuauuucuguaacugguuacagggagaaggucugaacaucaucaccagaccaacuccaaauuacaaaguuuuccagagcuuauauaccuucuaagcuauaugucuaccuguaagugugcauucaccuaaagacauaaguuacuaacuucuuuuaaucuauaacuaaggucugaguccugaagaccuuccuuuggagccucaguaaagugcuagagugauuacccuuaucgugucuccuacuauaucacauagguuugaggaguuccuucagaccccuaauacacuuguuuguggaggacuggggaguuucuucagacccccaguaaaacuuguuuaauccuaaauggcuccuauuaagaauuccuucauuauugaagaaacaaggaguuguucaaugggaacagaguuucaguuuuguaagaugaaaaaguucuagagaucuuuuacauugcaaugugcauauacaguaauuaacacuauuguacuauacacuuaaaaauuguuaagauggucaauuuuauguuuuuuuuuuuuaccauaauaaaaaaaaaacaauugugccaaaaaaaaaaaaaaaagaauuccuucauuauuuuaucacgcuuuaaggcccaggaaaggccuaggcaaaacucuugaugggcuuuuguuacaucccagccuuuguauaagggcacuggcuuuuaauauuuaacuuaaacauucagucaguacugaaaugguuguuuagugagaccuggccugugacaaguucacuuuggauaauggccuccagcuccauccauguugcugcaaagaauaugauuucauucuuuuuuauggcugccacguuucuuuuuuacgauuaacuuggccauguccuuugguuguuuucuuauucguuuuuuuuguuuguuuguuuguuuggguuuuuuuucccuauugauuuagaagauguauagaauuugccuuuuuuuuuuuuuaauuuuuuuccuucguaccuuaaaaaaguuugguagauuuugacauauaaaaguuuuaaaccuucguguaauuaacuccucaguccuuugauccacuuuucuccacauuugguaucaugcuuagaagggcauuuucuauuuuaaauaaucauauuuucuaauuuuuuauuuuccaauggucucuucuaaauauauuaauacaucuggaguuuuuaaaauaaugauacaauauagaaaccuauuuuauuccacuagcauuuguugaauaaacauccuuuauucaccuauuugaaaugcacuuuacucuuucuuagugaagaaacugguuaaggguacucuaauuauuuuuuuucucacuaaguuaaauuaaauauacaauucuuuagauaaacugggaacuguuuuuacacuuccccuucuuuuggaguuuugaaccaucuaucuuuucuuguaacaauauuauagucguauggguuuuagacacuuaauucaaacuaugacucuuuuugguuauaaucagacauucaugauguucuaauuauaaaaaaguucuaaguguuucugacuucuguagccucagaaauuacuuuauaaucuuaaauuuauuccuuaagacuuaccauaauguggcugggugugguggcucacaucuguaauaccaacacuuugggaggccgaggcgggcagaucaccugaggucaggaguucaagagcagccuggccaacauggugaaacgcccucucuacuaaaaauacaaaaauuagcuguauuaggcaugguggugugcaccuguagucccaucuacucgggagucugaggcaggagaauugcuugaaccggcaggcggaagcugcagugagccaagaccucgcuacugcacuccagccugggcaaccaacugagacuccaucucaaaaaaaaaaaaaaaagacuuaccauaauguagggcacuacacuaggcuuggagaauacaacaagaaacaaggcuuauaaggauccugccuaagggcccuaccugaaugcauaaugggaacaaaggcuaauagacaguuaucauaauguaugucaugaaacacuuuuaaugcagggaagguguugaaucagagaugucuucccggagggaaagaaccucuuaggaggaaagaaccucuuagcagaaaccuuaagaaugaguaaauugaguaaagaguguuuuccaguagucagaagcaaaauaauauuuuuccucaggggaacugaaaguaauucucuuuggaagguagagccuccacaaauugagaggaaagaaugguuaagagacugacuggaaagaucaacaagaauuaguucagauccugagacaauagguuuuaaucaagaaaaugacauuuucacauuugcaguucagaaaagucauucucccugcaguaggaagaauggauugaaaguaacaauugugacugggcacuuggacacuuuuuguauaauauagaugagaguugaagguggccuaaauuagagucaaagcaggaggaauagagaggcacugacaaauuagauacaguaaucccauuguaucagugguugggggggauacauuacaagaccccccccccccccaguaacugcagauaguacugaacccuauauacacuguuuuuuccuauaugugcuauguuuuuuccuauauguauguaccugugauaaaguuuaauuuuuauuuuaacaauaauaaaauagaacaauuauaguacuguauuauaguaaaaaguuauaugaauguagucucuuucucucucaaaauaucuuauuguauauaaaccacauaaaucaaaaccacagaugggggagacuauuguauuuggaaaguagaauugaagggugugaugauugaaugagggaaaaggaaggaauccaagauuaggcccagguuucugcagauacguguggagauagaagaggagguuucagacacguugcaauugaggugagucauaugaggaagucuucuauauuagauacaaagaucugacccuuagaagagagauggucuggcugugaauuuaggagucaucaaaggaugacugaagcguuggauauaaguaagaaugcuguggguagagcaaguauggaacccugaggaacaccaacauuuaaaggauaggcagagaaggggaaaccuacaaaggagccccauaagagugcuuagagagggagaggggaauuuaggaaucuaaggguagagaacucuucaaggagaguuguuaacauaagaaaugcuauucuaagggggcagauaaguagcuccugcccuuaguaagcaugaugagauaaaaggguuuuuuuuaaagucccuuuuaauaaagaaaauuuuaugccaauuccuuuaguuccucucccaaagguuuaccauuaaaggaaaaaccauuucauuuggcaaaauagaauuuuuguuguuguuguuguuguuguuguuugagacugagucuugcucuaccacccaggcuggagugcaguggugcgaucuuggcucacugcaaccucugcaacuuccgccucccagguucaagcaauuauugugccuccuccuccugaguacuagguuuauagacgugcuccaccacacccacugauuuuuguauuuuugauagagacagguuuucgucauguuggccuggcuaguccagagcuccuggccucaugugaucuccccuccuuggucucccagagugcuggguuuauaggcaugagccaccauacuuggccagaauuuuuaaaugcuguaguuuucaauuagacuccugaggcucugacaugauugcuuaaggacuagaaauccacauguacuaaaucacuguagauugaaugaauauuaauauuuuuuaaauguagaugugguuaaauaguauuuaaaaucauuagaaaauaugcuugaguuuggauauuuuguguuuucucugaucaacagagagcaaaguuguccugcugucauuuuacugucuuugaaauguuuugauuuuguaaagagaauccugcaggaggaaggccucuaggguguuguuacuauuuuuucaugacccucuugucccagauggucauuagaugguauauucacuuugugaugcuucacuaagauaugcacuguucuguauguuuguuguaucugaauagaaaguuguuuuuuuuuuuuuuuuuuuuuuuaugaaguagguuguaggggacugaguccucauaacccuaaaagaagaacuccauuaagucaacauuucuuauaugccaaaugacaagaacgugaccccauaccucccacccuuccaguguaguuccagguuaugguggggauaggacgauguugcuagauacuuuuuaauggacuaaugaugacuugggguuaugaguuuaacugggaagauuucaccaauuguucaugugucuuauuuuauauauuuuaacauuuaagaaaugcuaaacccaagccuaccuuuuagucucuacuuuuaucauaauacaaagcuguuguuccacuuacuugguucaucacagcaggaacauauguugauuguuuacauuuuguuauuguucuuuguauguuuaucuucugaugcagcugagguuccacuugcaugggaaucacuugagggaauuauuaaacauguauauuccaagguuccacugaagaccuacuaagaaauaauuuuuggccauggaggccugggaauuuucauuguaagaagucucccacacaauuccccaagugauugauggccauuauucugccaucuagccagacuaucaagcaucaacucaacuuuuauuuccccaugaaacaauuaccugugcuuaggaagauccgccucugaaugccuagccguacuuauuagcuauaguucuugugcaaauuuuuacuuaccucauugcaauuuuauaucucuguugucucugucauaagucucaacucugcuacuaaagaagcccuagauaauauauagcugaaugagcaucacuguuuuccaguaaaacuuuauggacaccaaacuuuuaauuucaaguaauucacacaugucauauuauuacuuuuauuuuuuccagccauuuaaaaaugaaauucuuagcucacaggcuguacaaaaguaggcagcagacuggauuuggcccuugggccauaguuuuugccaaucucugcucuagacuauuaucccaacacaauauuggucaauauacaguaaguaaauauaugaguacugagugaauuaauuguaacacucgugauuuuacacagagcaugcauaugaucuaguauacugacugcuuuguaaauauguguucaauaaauguuuauuaggucaauuuucaaacucaaguuaauaccagaguuaucagaguuuucuguuucuuuaaauaaacugcuuuuuucuccacuguguguuggaauaggaaggcccuaacagucugauuaaugaagaagaguucuuugaugcuguugaagcugcucuugacagacaagauaaaauagaagaacagguauaucuauuauugaaaauucuaagcugaaauuuauuuuaacacuauaggcauuccuugguguauauuauuucauguaaauagaauuugaacauugugaacuuaauaaccuagaagcuuaacugugaauacauugagucacaaauguaaaauaaucuuuuuuuuuuuuuuugagacagagucucgcucuguugcccaggcuagaaugcaguggcgcgaucucggcuuacugcaacuuccaccuccuggguucaagcgauucuucugccucagccucccgaguagcugggacuacaggugcgcgccaccgugccugacuaaauuuuuuuguguuuuuaguagagacgggguuuuaccauauuggccaggcuggucucgaacuccagagcucaugauccacccgccucagccucccaaagugcugggauugauuacaggcaugagccaugguacuggccguaaaauaaucuuuauaagucaguuccuuuauaugugaauuuccaagcaauagaaagaaaaccaauaauuguuaaaaggaaccaugcguaauuaacaugaacuuaaauagaaaugcucuuuuugcuuauuucccuuuaaguguccagcuuaaaacauucuuuuaauauaaagcauauauuuagucuaaguaaaaagcuucuuugaauuuuucuucaccaaguaugauaugaaaaggaagaugaccaaaaacuuaagguuuuucaucuauauuaguauuguuuuuauuaaccccuuuauuaccuucacuacuucaccuucaguuucuuucucacuuuugcuuuguucaguguuuugucaucauuauugaguguauagcaguuacacccagcugcuguggaaauugaagaaaaguauuucuuaaacccauuaacuagcuucaagauuaauuugauacuuugucuucuuuaauuuggcaacaguacaguuaccauacguuacaacuagaugguacuuaaggaugaauuuuguuauuuccuccccuuguuuaagcuaugcuaguuaugguggaagcuuaaccuuuuuggggggcaaguauuaauaaacuguggcuacagaguaucuugccaaauaaucauguaugugucaguuuuauacuacaaaugaauuugcauagaaaaguuggcuuguucguuucuuaucauugcuaagacagucauggcuauuaugcucuuauuggucuaccuaaggguaaaucaccugcaguaguaacugcuucucauguguaucuuucguuauuuuuuuaaaaauuacugauaaaaaguucaugucacauuaauuuguaaagcuuauugcucauuuuuuuuauacccaaaagaugcuauguaccacucaagaagagugggaacuuuuaguuccuaaaugggcucuacuuuuggaaaccuaaaguacuaccugaaguagcauuauuuauuuguuucccuuaguuuuuugucuaggaugugcuguuuugggaaaaaguagugaaugagucaagacaccucagucuuacucuuaguuuuaccucuaacuaacuuuguagcuaugaacuuaucacugaauucucugggccuugguuuucuaaucugugaaacaaaggagacaagaugauucaaaacaucucuucucucuaaaaugcuacucuacugaauaucaguauggugauugaguuggguuugagagaauugaugaacccuuccguaagcuuuagaaaaagaaauauucauggggccauccaaucaacuucauucuauucuugacacuguacuagaugcucugcaaaauagucauugaacagagcauuguuuuucuugccuaagagccaggcauguugauaugacagagauacagugugguaauacucuauagaguagugagagcuucaguaauccauaaaaucaguuccauagauuuagaucauuucccucuucauauucaguguauauugcacagaucucucaacaacacagccauuaaauagauauucuccaagugacacuuacaucacacauguuugaguuuacguuacuugcaaacauagggaaagaaagauacaugggauaaacuggugcaugagaaaugagaucuuagcaguugguugaaauaaaugagaacaacugaggcaaacuaaagaggaagaagggcaaguggcagcuuaacaggaguaagaugaugagaugaagggcagaauaccuucauggagaggaggcaaagagauauacaugauauguucuuaggaacauaacugaagcaaacaaugauauuauuucuaauuauauauaaaccugugagucagccuuccaggggcggccugcuaagguagaaucauuggaaugauuuggccaggguuuggauaggagagaauuggcagcagcguuaagauugacccaugauaaauaaugcuaugcagguagcagggagucugacuaggagcaaaaucaacgaacuuaucccuugccuaacauaguaucuguggagucagaaagaagagguuaaauugggauaucugaggcaaguaucaggauuugccaugucugcggaguaguuucauaauucuaaugguuauaagcacuaaggcguucacuaagugaauguugguaguuccagguuauauuauccauucuugaguuacaaaauacacuuuaaaaccuucccaucuuaauauuauauguuuuuuuagucacagagugaaaaggugagauuacauuggccuacauccuugcccucuggagaugccuuuucuucuguggggacacauagauuuguccaaaagguaagcuaaugucagaguuuacuaaaaguacaccuuguauuguucuucauuguugguggaaauaucuuuuauuugagacggagucucacucugucaccagaguggagugcaguggcgcgaucucggcucacuacagucuccaccucccggguucaagagauucucgugccucagccucccugguagcugggauuacaggcauguaccaccacacccagcuaauuuuuguauuuuuaauggagacaguuucaccauggccaggauggucuugaucuccugaccuugugauccacccaccucagccucccagagugcugggauuacaggcgugagccaccaugcccagccggaaauaucuuguaguauauaaguuuucuccccuuuucauuaauuuaaguaaugagacuguuuuugguuuuauauauuguauuccauauacauccuccaaaacaguuagaaauuuuguucugaaaauaaaguucuuucauuuuuauuuaaggggaaaguugggggugggcaaauaaggaguggcuaguccaaaauaguuaaccagaaguauauccaguuauacuaaaucucucucuucuuugggguuaaaugguauuacuuuguauuauuggaagcacuacauucuuuuuuggaaugauuuuggaacauaauacauaauaggugcaugaagucagcaguugcugcugugcuuguuucauauagugcuuuguuuucucuucccuuuaucuuguguuuggaaguugguacugaaugcucuguugugccuuuguucugauuacuugguuuuuucuuugucugucucugguagcccuauagucgcucuuccuccaugucuuccauugaucuagucagugccucugaugauguucacagauucagcucccagguacuguaugaauguauagaguggacuugagucuuucugugcuauauuucagccugcuuucccaguuccuagaaaucuuuugguuaggccacugauuuuaguuuugaauuuuaaauaguaacauuaagcauuaaaaaggucuuccuugucuacuaaauaguuccucugucagguuugcauguguccuuuacuauucacagcuuggaauuuugucauauaggagguacuccagaaagauuuucaaacugaauugaaacaaauagaagauacuggguuuuguauaucauguaauaucuguuucuucagucaggauuuagcaguuuugauggacguggucuauaugauauguuauagcagaaaagcagauuuuaacagucucacuuuuaagcuaaaguaucuccaaauuauauucaacaaggaaaucacuuuuuaauaauauguuucauuuccauuauaauacuaagcucuauugagcagauuguguuuuccuuaugcaaauuaccuuuggauauuauaaaugaauauuucuguucauaugcuaaaucuauggaaauuuguuuuaauuuuuagcauugguaaggguuuaggaauuuaagacaggaagcuggaugcuugcggucucuaaagucuguacccucaaaauaaaaucagauuaccauuggaagaaguuuuuuuuagugucagcguuaguucuuuuuuuaauuuucuuaaucuucacaucuuugccauucaacuuuuuaucuuucuggugauugcauuuuauuggacuagauuauauuauguuaaucuuauauuaaagaccugagcacucuggucagaaugacucaguuuaaacccugguuagguguaugaucccaguaaguuuucuaacuuuuuugugcuucauuuuuaugauuuagcuagaaccugacacauaauaagugcucaauaaauguuaccuuguauugcuauuauaacauaauuucuuugagcuaauaaaaguuaucuacaucauuauuuuuuccucugugagaguauugcuauaaaaguuuuuaaaagucauaguuuaaagagauuucuauuauuuuuauguuuauaaauaaaguuuacauuaguuuuuaaccugcaauagagaagaauauuaagacuuuaauuuuucugacuuguacagcguuuuucuccuugaauacucuuaagaaaaagauuuagcaauucuggaucagaaaucauccauaaccaaauauaccacaguauauuuuaccuuuugcuuguccauuuaugcauuuuuuuuuaauuuuacuuauuuauuuucgagacagggucuugcucuguugcccaggcuggagugcaguggcacgaucugggcucacugcaaccuccaucucccagguucaagcaauucuccugccucagccucccaaguagcugggauuacaggcacgcaccacuaugcccagcuaauuuuuguauucuuaguaaagacggguuuucaccauguuggccaggcuggucuagcacuccugaccucgugaucugcccaccucggccucccaaagugcugggauuacaggugugagccaccaugcccggcccugcguauguuuuuaaaaagagacucauauucauaaugaaucugugacaaaacuacauaauacugggagacuuugguuuauugugcuaagcuccacauugcauuaaaaucauaucacagacuaaucaaaaaugcaggaauacauaggcuauaaaugaaagaaaauauaaugacagcaaagaaagaauguaagccaguaauaaagaaugccuaagaauuagggguucagaacccaaaccagggcccucacuguagugcuguagaacagcugaauugcuuuuaaguccagguaacuauaucacugagaagcaggugccuauauuuuuacaaaauuuugcugacagcuuacuucuucguaauauuaauaaccuuuuguaaaacucauguauguaacuugagagaaaucuugcuggauuuuuuucucuaauauauggugcucaugauugaucagauccuguuuuagccuuugauuauguacuguuuuauaugccagaagagguaaaaaugaagaaaauaacauuaaggucuucaaguauuuguuguccuugcuaaagcauuaguugucauuagcagacguggacucuagcaauucacuguuguaauuaaauugugugccuuauguucagcaguuccuuuauaauagaugacuaauucccaauugauaagauuuuuuguuucagaggauguuacacugccuuaucagccauuaucaaaggaucuagcaaguugauucuguauagucacacuugagaauauagcauuggauguagaucuggaguuaauauuaguugagaaacauuguguuaucuggaaaacucuuccaguucaacacaguguaaaauuauaguagugacuauacaguaguguuacauuuuacaguucucacacccuauagagacuuuuguauuaagcaaaauaagaggcucaaagguuauucauuaacauuagaaacacuuauguuauauuacauugcaucggucuuuucuguuuuuuguuuuuuuuuuuuuuuugagacggaguuucgcuuuuguugcccaggcuggagugcaaugguacgaucuuggcucacugcacccucugcccccuggauucaagcgauucucuugccucagccaccugaguagcugggauuacaggcaccugccaccacacccagcuaauuuuuuuucauuuuuaguagagaugggguuucaccauguuggccaggcuggucucgaacuccugaccucaggugaucugcccgccucggccucccaaagugcugggauuacaggcaugagccgccacaccuggccuacaucguucuuaauacacaaauauacaucaguuacuccacagcgcuugauaugggagguaaccaaauucuuuguuuuauaauaucuucauaauuaauuaaaaaacuaagucgacauuuuuaaucaccuuuaauaauuugccaaaauauuauauaagcauaauauaaucaauucuuacuuacuccaacaaauuuuaaaaguccagauacagauaccauaucuaguuucuugaucauuuauaucagcucccauacagaagccuucuaaaucucugguaauuucacuuugcuguuuauauaaguguuggcucaugacuaccuuguucuucuugaaaugauguuuuauagccuugaauuggcugaaauaaucaaguguacaauugagagaugcccugaaaacagcuuaaaauaaaauauguacaucuacuaggaaauuaguaccaacacaugaaucugucugaugggcagauauuaggaaugaagucacuccagaucugagaaauuaaaguuguaaaggacugcaaguucuguguuuuuguuguuguuguuguuguuguuguuguuuguuuuuucauuuuuguuuuuuggguuuuuuugagacagagucucauucugucacccaggcuguagugcaguggcacgaucucaacucacugcaaccuccgucucccagguucaagcgauucuccugucucagcugggauuacaggcacacgcuaucacacccagcuaauuuuuguauuuuuaguagagacaggguuucaccauguuagccaggcuggucucgaacuccugaccucaagugaucugcccgucucggccucccaaagugcugggauuacaggccugagacaccaugcccagcauuuuuuuuuuuuuuuuuuuuuuuuguaaagagacaagguuucacuuguccaggccaagugcaguggcaugaucauagcucuguaaccugaccucugaccucugacuuccuggacacaagugauccuccugucucucagccucccaaguagcugggacuacaggcauuccaccacacccaacuaauuguuuuuauuuuuuguagagacagggccuugcuauguugcccaggcuggcaaguucuugaaauaauggcuguggccacaaacuagaaaauaauuuucagguguacagagaauagaaagaauuuagauucauaaauugaucauuuuguucacaguuauuugcauaacacaguucacauuuaaaggugucaccuuagaaaucaaaggggaagaacaucauccucuauugaaaaagaaagaaaucaaaggauguacagugaauuugcagcuuaaucuauggggagcaucauugcaaaaaaugguucugugugaggcucuuucccacccuuuguccauaggagcacauuauuguuguaguaauuauuucaccccucucccuuuuucaguguacaagugauacaugcuaauuuuaacagaacuugaaaguagaauaaaauuaaaauaauaguuuacuaauauuccauuuaucuucucucauauauaugagauaaauauuaagguguauguacuuauccauaugugccugauuuuuuaaaauccuuguauaugcaucuuugcacccuuaucuaauuauuuccuuagaauauauuccuagaagcauaauugugggaacaaaggccaugaacauuuucaaguguuuauuuuauuauuuuauuuuauuuuuauuaauuuugauacaggguuuugcuuuguuccccagacuggagugcaguggugagaucaccacucacugcaccuugaccuccuggacucaagcgauccaccugccucagucuccucaguagcgggggcuaaggacuacaggcacaugccaucaugcccagcuaauuuuuuuauuuguagcagagacgaggucucacuguguugcccaggcugcuauuuuauuuauuuuuuaagagauagggucucauucugucuuccaggcuagaaugcaguggcacaaucauagcucacugcaaccucaagcgaucuuugccucagccugaguagcugggacuacaggcaugggccaccacucucagcuaauuuuuuuuucaauuuuuuauuuuuuguagauaugggggucucacuguguugccuaggcuggucuugaaccccuagccuaaagugaucuucccaccucagccucccaaagugcuaggauuacaggccacaggccucagccaaguuuuaaaaauuuuuacugccaaacucuucauuagaaaaguugaaccagcuuacauucccaggccaguuuucuauugauauaguagcacugaauauuauaauucaguuaacuuuugucaauacgguaggcuaaaagugcuauguucuuagccaucucucuuuuggguuaacagugcacuauuuuguuauuaauaauuauucuaucuaacaagcccccucuaugguuuuguggcuuuguaguaagcauaguuguauuuccuuuuuugagguggagucuugcuauguugcccaggcuggagugcaguggcgcgaucucggcucacugcacccuccgccucccggguucaagugauucuccugccucagacuccugaguaucugggacuacaggcaugcaccaccacgcccagcuaauuuuuuauauuuuuaguagagaggggaguucaccguguuagccgggauggucucuaucucuugaccucgugguccgcgugccucagccucccaaaaugcugugauuacaggcaugagccacccugccuggccaacauuucuuuuacaugcauaaaagagaucugagcuguuuuugagcccuucuagacuuucuuuuuuuuuuuuuuuuuuuuuaaguagaugaggucuugcuauguugccgagacuuaaccucaaacuccuaggcccaagcaauccucccaagcugcugggacuacaggcaugaaccaccaugcccaacuuagacuuuuauuguacuaucaaaaggcaauuuucuuuucaaauuucuggguaauaguguuagaaaaauccuacuugguaacauccagaaauggcaucauacugagugauucaaaugugagauggaagaaaagguuagaauuggagugaacguccccucuuaucucaaauguauuuuaucuccauuuuguuucauaguuuauuaguuugaagaugcuuugaaugucaccuaaucauuuucaacucuagguccagaaaaaucaagggcaugauuucugaaauuacacuuagccuaauuaaaacuuagaaacacuguucaccuucuucaauguuuuugacugagucuuuuucauuuauaagugacaggagguguuacuauaacauuauuuccuagaaugucaaauuuugagccuaauagcaugguaaauuuggcuauauuuguuguuuuuuguuuuuguuuuuuuuuuaaugaaacuuaguauuuccuuguuucccacuucuuuuuuuuuuuuuuuuuuuuuuuuuuuugagacggagucucucucugucauccaggcuggagugcaauggcgugaucuuggcucacugccaccuccgccucgcagguucacgcuauucuccuuucacagccuccugaguagcugggacuacaggcacccaccaccacgcccggccaauuuuuuuguauuuuuaguagagacgggguuuuaccauguuaggcaggauggucucgaacuccugaccuugugaucugcccgccucagccucccaaagugcugggauuacaggcgugagccaccgcaccuggccucccacuucuuuuuaauaugucgugucauaacugaacaguaaagugagcagauuaucagguuaaaucugaagugucagucuggucaccagugcccaaguuacugccccuaugguaauauugguuacuuuguauuuuccuacagcaaacauaaaauuuguuauagugagauuuuuaccuguauaccucucuuaacuuuaauguuauuaccucaaggaagauauuaucaugaaugaagauuccaugaugaaaguuuugcagaguuuauugcaguaauuuaguacuucauuagaaucuuuaguuuuuuaggagcacaguacugaauguuuguuucuuuguuggaccuuuugaaaaccgguuuuccauugaugcaguguagcuguuacaggaauaucauuuuuaaaacguuuuuauacagcauggcugaaaauugaaccugggccucccucguggccuaccauugaaggaacagcauuuuuugccuaucuagaaagacaauguuaaaugugcuaucuauauauuuuuuaacuugugcuaccuacuacgcguuuauauuuguggaaucuguuuucuuuuggacaaaaccacaaaucaaaaacaccucauuucuuaggcauuugaaaucccuaauucagaauaaucucccaaacagaaacacaacuaccugcauucuuuuugacaaaagagcuaaguagcauuagaaaauuauuuuaaacccaauucuguuuuuuaacagaauaaaauucuucuguucuucacauucuucuuucauagguaaccuauugaaaguaggguuuauuugggggaagcauuucuuucugucucuuaucucauaauaaauacaggugugcuuaacuacuaguuuccuaccucaaagauauacucaaaucuaaagauguuuaagauuuugggaucugaagaguaaacauuucuccuaaucacaaugugacagagacaaaugaaucaagccaaugcuacuuuuauuuaugcauacuaacuggaacuuuucuuuuuggaaaucagauacauuuuguauguauuaguaauuuggaauccugcauugguuauccucgcccucccaaagcagauucugaaauuauaaaggugcacagguucuccaugcaacaccaaaaguuauauuuuccaaggcuuuguaaaauuguagaauguccuguuaaauuucugucaaaucaguaacucacacuguuuugagaauuaugaauaaaggaauaaaauauuguuaguguuuauuuaguacaaaaguagauuauagaaucucagcauuuuugucaaaaaauuucuuuuugaugauugacagaucaggagacacuuaaggccauaccugcuuucaguaaucaaaaaugcauuuaagauccagaaacuugagguagcagaacaucacuaucacauauaacauauccuuugguauagaaaauuauauucccagagugaguuucuuuuuuaaaaccauuaaugaggccaaggugggaagaucacuugggaccaggaguucaagaccagccugggccagauggcgagacccugucucuacaaaaaauuaacuggaugugguggugcacuccuguagucccaccuacucagaggcugaggcaggaggaucccuugagcccaggaaauuguaguggcagugagcuaugaucauacuacuguacugcagucugggccacgaagugagaccgugucucuuaaaaaaaaaaaaauguuaggcaugguggcacaggcauauaguuuuagcuacuuaggaggcugaggcaggaggaucacuugagcccagaaguucaagauuacagugaguuaugauugugccgcugcacuccaaccugggugacaaaauaacccugucucuggcggguaggggggaaguugauuauuuacuuugaaauauguucaaaacugauuccuguucuauauuccuaaugaacagaauagacuuuauauaaaacaaauaguuaaacuuaaggauaaaauuuuaauggaaguauaauauauauaucuuccagcucuucugucuucuaauguauuuauuacagaaaaugaaauuacuuuguuuccgcaaucuuuguaucacuucaguucuccaauaaaucugagaauucugguagugugaaauauucagcuuucuuugcuuauuuacauaaaauguauaaggacaauuugugauaauuaagaguuacauuuaaauaucaggaaaaaguuauaaauuuaaauuaaaaaauuuuaaaaggaaauuauuagaaauuuuaaaagaaugaacuaaaaggugauuauauguaaaugcuugcauauaugaauauuagcauuguccccaaaauaauuuagaacaaagaaauuggaaucaaauaaauaaagguuugauuauuuuuaaauuggcuuauauuccaugauaaaagagagguuuaucaguggcauaagaaagguuuuucaccuuuuuuguauugaaaucuuugacauauacauauauaucuuugcucaucuuuguguaucuuugcucguaugagagcaaagauauaggcaaagauaugcucucucucucuaugucuuuguucauaccagaccuuccugauaucuccacauaaucuuaaauauaggaacauuagacuggaugaucucugugcccccuuuaucucuacucuuccauuauuuuauacuuuaacacaucaucucuguuuuaugauauagaauggaauauuucuuuuuuccugaaaaugcuuauuuuggucacuugauacacauuaggccaauauguguuacuugagugacccaucuuccuucuuuucauuucugucuccugucauuaaccuggauaucuggaauguggacuaaacucuucaaacacuauguaaaaccuacuaaccuuugugcauuugguugcucagcuacuaagagcaccauuucugaacugaaguuaacugaagaccauucuguuuuagagauuaugacauaccuuuuggauucucaugccuuuuuccucccuucucaagguugaagagauggugcagaaccacaugacuuacucauuacaggauguaggcggagaugccaauuggcaguugguuguagaagaaggagaaaugaagguaauucccccugaaauguuauagauugccaaaggcgucucuguuucagucauauuaucauuacuauugauaugaauaaggauagcacuuucaacuuaccuuuaaaacaaauuauuacaugugaucaaagcaguaccauauauugagcaauaaaaugucuuuuugcuuuucuggcuuugccuuuacuaaagguuuuuaugauuauaauauaaauauaugauuaaaccuuucuguuuugacuaggccaugaagaaaauaaaauuuagagaauuagauaugaccaggucacaauuagcugaugguccuguauuuggauauuuccuuuuguuuuguuuuuuuaacauacugaauguugugccuagaugacacuuuguuucucucccuuuuuggucuauacccuccuucuuuucccuucucuuacugcaccuuuauuugauauuuggacauuggucaguuaaucuuguuuacaucccuaaacacaaggacagaaaauaagagcagggacugagagauacagagauggauugaaaagcaaaagcaacauugaauuuuggauuuucucauuccuaaggaacuaugcuaaauaaagauacaaagauaauaagacacucuccaagcuaaagcuuuaguuaaggaaaaagaauauugacauuuaaaagauacuauuggccaggcacaguggcuaugccuguaaucccagcacuuuuaggaggacauggcaggcggauuacuugagcucaggaguucaagucaaaccugggcaacacggugaaaccccgucucuaccaaaaauacaaaaauuagcugggugcaguaccacacacuuguagucccagcuacccaggaggcugaggcaaaagauuccuugagccagggaggucaaggcugcaaugagccgcguuugugccacugcacucuagccugggucacaaagugagacccugugugagauauauauauauauauauauauauauauauauauauauauaugcaugcaugcuauacuuggcuccaucugauaauguacugagugaagaguacagaugagugguggagaaaaucagaaaagaaagaucucugugauuugaaacaauuagauuguuuuacaaugcagagaagcauuugaacuacaucuggaauuaaaaagaaaguugugacaagggugaggugagggcauuuuaggaaaaaaauuauaaugugagcaaaaacuugaaagcaaacuuuuuagucaggauuuuuugcauaaucuauguugaccagaauuauucuagcaaauaagauauaauauuagaugcugggauuuccucuccccuugaauaaggaacaaaguaagacauaagauaaaacagacagauaaaugagauaccagaauguuagcuauaauucugauaaggugauuguagaaaauaguuugagaucagcugcuacagggucuuguuacuccagaauuaagcauguuccuggcauugcuggauaaucacaaaccuucacuacagaagcaggccaggauguaugcucuucgcggaagaaaggguugagccagaccugccuuauuucuucuucuguagucaucguucagucaccguagagucaccucccucuggggaggaggaagugaaguacuaaagagaagccaggagugauggucuggaugacgucccucuaccuggaaugaggaauagaaaauaacuacuccuacagcccacaguguuagagagaaauugggccuagauaaugggaagcauaaaguuacucucuaaagagaacaaucguugucuauaacaauugucuacaacaguagacuagccacuguaugaaaaguaucuuuuuuuuuuuuucuuuuuuuugagacagaguuuugcucuugucacccaggcuggagugcaauggcaugaucuuggcuuaucgcagccuccgccuccuggguucaagugauucuccugccucagccucccagguagcugggauuacaggcacccgccacuacgcuggguuaauuuuuguauuuuuaguagaaaugggguuucaccuuguuggcuaggcuggucuugaacuccugaccucaggugauccgcccgccucggccucccaaagugcugggauaacaggugugagccacugcgccuggccugaaaaguguaauuuuaagaagaucaagcugauagggaagaaacuggagaacaagcagacuacuuaaaagagucaggcacaaagugaugaaagccuaccuagaacaguagaaaagucaaacuguuggaugucuuagcgaagacauuuuagacaaaaaauaauaaugugagcuagaggccucccugcucugcaccuuuggcaccacaucuaggaacugccagugccauggugucaauagauuccugccucaccccuaaucaucucuucuaugcuuuauuaagaacaguuuuugacugguggcaguggcucauaccuguaaucccagcacuuugggaggccaaggcgggcagaucaucugaggucagaaguuugagaccagcuuggccaacauggugaaacccugucucuacuaaaaauaccaaaaauuagcugggcguaguggcaggcgccuguaaucccagcuacucaggaagccgagacaggagaaucgcuugaaccugggaggcggagguugcagugagccgagacggcgccauugcacuccagccugggcaacaauagcgaaacucugucucaaaaaacaaaaaagaauaguaaagagcuuacuagcugugugaacuguaaagggaggaaucaaaagucuagaguuucuaguuuggguagcugggaaaacgguggucccaauaauaugaguaauaaauagguaggggaagguagucuguugagagauacucuaagaaaaucuaugugaaaugccuaacaguguccagccccauagguccuucauaaauuggcacuugguucucccccaugaugacauguuucauuucucaagaguauuuaucacauaauuaucuaaaguagcaaacucuauaauuuuaaaauaauuaauuuuacuuagcauuuaagguauguaaccucaguauuuaaagcaagauagaucuguauuuacguuuuugccaucuuagcuuucagccauugauuuaacaaauaacugagugccuauuguguuucauauacuauucuagcuguuggggauacagcauugaacaaagcagacuuaauuuaguaucuuuaaggagaauauauucuagccagguuuauuugguuuucuuagccauguuaaacagucuuuugagaaugguaaauaaugccuaauucaaauugauacauuuauuuuuaaacaacucacaauaagucauuuaucacauaugcauguuuuuaucugagguuuaccuuggauuuauaauuuuaaguacuuuuuugucuguuaauuugaaauuuuuaauuuucuuuuagcagaauauguucuauaaauagacuuucauaaaaaucuaaagagcagcuguauuaaaagcaugcuuuccugcuuuuaugggcuugauuuuuaauuuucaaacaguuuuggaauuauguucucuuuagguauacagaagagaaguagaagaaaaugggauuguucuggauccuuuaaaagcuacccaugcaguuaaaggcgucacaggacaugaagucugcaauuauuucuggaauguugacguucgcaaugacugggaaaguaagcugucauuauuaauauauuuuaaucuauuauuuugaauuuaauaucaaauccaaccuaguuuucugcaucuccuacauaguuuacaaagucaacguagaaaguauuuggaaaaucauauagaggacuagcaauacauuuauguagagcuuuucaguguaugaaaugcuuccuaguauguaauuugauccaauaaccucaguaauccuacagugauagguagguauuauugcuuauuuuacauacaaauaaaguaaaauucagauaggcaaagugacuugucaaaggcaacaagagcuauaugguggagaagccaagacugaaauugaagauuucuguuucaucaucuacucuuuccuaaacuguuuccgugguaaauccuaggugaauccuuuugugauuacuuuagaauuauuuuauuuuuuuagacagaguuucgcucuugucacacaggcuggagugcagugguaugaucucagcucgcugcaaccuuuaccuccccaguucaagugauucuucugccucagccucccaaguaacugggauuacaggcgcacaccaucacgcccagcuaauuuuuguauuuuuaguagagacgggguuuugccguguuggucaggcuggucucgaacuccugaccucagguguuccaccugccuuggccucccaaagugcugggauuacagaugugagccacugcacccagccuagaguuauucuuaguguguauuccccuuagacacaaaauuuccuaaguauagauacuucucaacaucaucagauguuuaucauuggcaguuugacaucucuuuuucacagaaauagccaccuaagauuagauauaacaauuuauuuaacaucaauaaauuggggaaaagggaaggguuuuaguguuagggaauuauuugugccugagugaugcaguggugauuagaauugcuuucuugcuguggaagauagauaauugggccaaagaaaaugaggcuuccuggugaucagaccucacaucccuaaucuguaaccauaauacuaaguauuagcuaccuuccauuuggauguaaccuagauagggcaggauccuguucaauuuaccauacuguccauucguacuugacuuucaacauaagugaauugaucacauucuaggaaaagauaauauaucuuuuuauuauucucuucauuucagcaacuauagaaaacuuucaugugguggaaacauuagcugauaaugcaaucaucauuuaucaaacacacaagguaaagaucucuucauucauccuaaaaggauuucaauguaguucaaacucagacauauagauucucuaaaguaaaauuggggagguuauuaaaagccacaaaaauccaaagacuuuauuaaauaaugauucaugaaugucauguauuuaaaagguauaucaacuuguucagaacagaaauaugugcaggcaagaaucugagagauacaaucuagaaauagagugcuugauaaagaucaacgguuaguucccuuugugcacuuuuuauuuuuaaagagacagggucuugcuguauuucccaggcuagucucaaacuccugagcucaagugauccuccugccucagccucucaaguaauuggaacuacugguguaugccacacucuuagcuuucuuuauacacaguuuaagucuagaaaagagccuucugaaauacugaaauccauuuaaauaccuuucuaguaucuaguuucuauaagagguaaaugauaguuaccaaauaugaaagugaauuauagcuuccugugacaacaacaauaaggguaauggcuagcaugguauuagccuauguuaagacuaauagauauaaaaguaaauggauuaucugaaagcaaagaaaaaucacagagcgugacuugagagguuagucauacaccagagcauacagaaacauaauuuaaguuagcucccuuucaccuuauuucuucugcuauucuugauauuuaaaauuauagaaucaauaguucucuugccuuauucugcucuuucucuucugaaaacugcccaauaacauaauguguauagcauaauaaaaggaauuaaaauuuuggagagauccaccaaaaacaguauuaaacauuauaaaagaaauguaaugauuuaauagguacuuuguuuuuccaauucagugagugcuucauuuuucuuuuuaaaugguuuuugagugcaguauaugaaaacauuauaagucuguuauguauuucuuaaacucagucuugucaucugagacaucuuauaucuaauaauuaggagccauacuuaauuuuacacgguagcugcucagaaaugcauaacaauuaagauucuguuucagcauacaaauuuugaagucuaauuugaaaucuaaaauuuaguaaaugucagaauauuaauuaaucacccuauaauuuggaaugaagauaaaugaccaauaauuuagaaccaaaagaaccuuauuaucugaaaauaauccaucauggaaaacaaucugcugaagguauucugcuagauaaauaguagauggagggagggucauauaaguuguaucaggauugaaaaauaaaacuaaaaauuauuaaaauaaucuuauauguaacaaaauuuguuacaguuauaauuauuugccaauucuuggaauaaacaaauuguccuggaaucauuuuuucaagaaaaucacauuacauucgcaguguauguaacuauaccacucacacuauaucugaaauuuaucaucaccccaaacagaaacuccguacucauuaagcaacaacuccccauucccucuccucccauuccauaauaauguucugcuuagacucaaagucuauaguguuauuuacacuacaauauuuuucccuuuaaauuugacaucuuuugcaguauggucuuaaaagagggcuacuggucucuugauauuuaagucauucucauucuuuaaauuucuaucuuaucauccuguggauuuguauucauuaggucuaaauuugccaaaucuucauguauuacuuacugucuccacacaauuuacccaacacuauauuuaucaacuacaugaaauuuuguaucuuuaaaaaaugaaucauuucaucuugcaaaugauuuguauuguaugcuauuuauuacucucaguaaucaggaaugacgcugcauaacaaggacuaguccagauacauauacgagauaaccaaaauaaaaguaacuuaaauaggauaaaagguuuuuuuucucauuuaaaguagguagucccauuuauugaagaccuaggcuccaugucauucccauaguauauguuuccccuugcauaccuuaauauugaaauauuuaaucuaagugacuuagaauucuuucuaaugugauuugauucaaauaagucuuuuuucauuaaaucuuugaaucuaaguagaacauaaucauggaguaugaggagagaggaauggaaaguuguugcuuacuggguacagaguuucuguuugggaugaugauaaauuucagagauagcaauaugguuacauaacacugugaauguaauuaaugucccugaauuguacccuaaaaguuaguuaaaaugacaaauuauacguguauauauuuuacugcaauuaaaaaaauagaacauuauuccuuuuauuauauuguucugcaaagcuauuaacucuguucauaauuaaucauuugguagauauccucagaugcuuuccauuuaaaauuugagagauuuuaccuucaauuaagacauuuauuggcauuacguuucucuuguuaguuccauguuagaucuguuuuucaaaagauuuuuacuucuccacagaggguguggccugcuucucagcgagacguauuauaucuuucugucauucgaaagauaccagccuugacugaaaaugacccugaaacuuggauaguuuguaauuuuucuguggaucaugacagugcuccuguaaguacauguauauaaauguguauaauuaaacaauauaaagcuaaauacacaaugcgggacaaaaaugauaaacacagcccauacacuauacuugauuugauaaugguucuuagauuuuauguuggauugacugcuaggaacaguauagcccauguguugucugagggcaacagucaugccuaugaacauuccaccagggccguuuaccuuuccuucuaauguuucgugaaacagccaaaagggcaguacauacacugggcaguaggcuacuucccacaguuaucucuuaagccguuaucaacugccagccaaaccucugugguuuaccacaauuuagcuccauuuacuacuuaagaggaagggauccugggcaacaugguuagaccccaucucuauuaaaaaaaauuuuuuuuuuuuuuuuaauuagccaggccuggugaugugcaccuguggucccagcuacucuggagguugaggcgggaggauugcuuugagcccaggaguuugaagcugcagugaacuaugauggcaccacugcacuccagagugggcaacagagcaagaccuuguccccagaaaaaguggguggggaggaauccuggugucauaucagcuuggugcuuauaagauuucacuggagauacuuuuaagaguuacgauuuugguuaaccuaauauaauauuagaccagcagaguuuacaaaauacuggguaucuacugaugcuuuguuuuuuguuuuggcagcuaaacaaccgauguguccgugccaaaauaaauguugcuaugauuugucaaaccuugguaagcccaccagagggaaaccaggaaauuagcagggacaacauucuaugcaagauuacauauguagcuaaugguauguauuuuauuguuuuugcucuuugauaauguggcuguucuugaucaugaccuauaugacaacaauuuggacaaaugccuuuuuaguucuuauccauuagauuacuaauuuuuaauuuggagaaagguauaucagaauuacuagagaaucuuugaaaguacagaugucugaauuucacccuggaacuacuacuauaugaguauuucugaagcuagagcuggauaggaaaauuuuaaaacuuuaucccuaggucacuguauauacccuucuuuuuuuuuuuuuuuuuuuuuugagauggagucucguucuguugcccaggcuggagugcaguggugcagucucagcucacugcagccuccgccuccuggguucaagcgauucucugccucuguagcugggauuacaggugcccacaaccacgccuggcuaguuuuuuguauuuuuaguagagacgggguuucaccaucuuggccaggcuggucuugaacuccugaccucgugauccacccaccucggccucccaaagugcugggauuacaggcgugagccacugcgcucgaccuagccuucauauuaagcaccauuuucuuagauauuugccucauagaacagauuuauuauuaggaauauaagcaacaguggggaaggaaauuaagaguucuuuuacucauugucagccuuuuuagcuuucugaaucaauguuccccuaguccuuauuaguugcuaguuacauauuuauuucucuuugacauucauugucaggcuuuuuguuuucugagucagcguuucccuaguccuuauuaguugcuaguuacauauauuuguuucacuuuggauaggucuuuucauugcuugcuuuggguccuuacuucaccugcuuugcaccuggaguaaucauugcaaccucucucaucaaaagucauaccuucuuuauacagggccauaacugcuaguauguucaaagaaacaguuguaccugaguaaguuacuauuucauuauaguacagauuugugaauaaucugcccuaaauaaccuuaaguggugcuauacuaauuuuugcagguaauuucgggaacuaagaacauuguagaaagguuauagaugcuuucuuauuugcugucugauuaugucugauggauaguguuaaggaaugaaggguugggacuuaaaagaucauaauugguccagcuggguacagugacucagccuguaaucccagcaccuugggaggcugaggcgggcggaucaugaggucaagaguucgagaccauccuagccaacauggugaaaacccaucucuacuaaaaauacaaaauuagcugggcaugguggcgugcaccuguaaucccagcuacuccggaggcugaggcaggagaaucacuugaaccccggaggcggaaguugcagugagccaagaucgcgccacugcacugcacccuggcaacagagcaagacuccgucucaaaaagaaaaaaaaaagaugcuaauugguccaaugugaggaauauuuuaaaaacaagggaacaaauuaagugcuucacauauguuuggagaauuguaucuuaauacauuuuaauuuuccuuuaucuugcagugaacccuggaggaugggcaccagccucaguguuaagggcaguggcaaagcgagaguauccuaaauuucuaaaacguuuuacuucuuacguccaagaaaaaacugcaggaaagccuauuuuguucuaguauuaacagguacuagaagauauguuuuaucuuuuuuuaacuuuauuugacuaauaugacugucaauacuaaaauuuaguuguugaaaguauuuacuauguuuuuugauguuccccuauagaguauuguuucguugguuuuuguuguugucguuguuguuguuuuaaacagggucuugcucuguuuccuaagcugaagugcaaugacaccaucacggcucacugcaaccucaaccucuggccucaaacaauccucucaucucagccuucccaguagcugggaguccccacaggcaugugccaccaugcucagcuaauuuuuuauuuuuuguagagauaggggucuugcuauguuacccaagcuggucuugaacuccuggccucagacaauccuccugccucagccucccaaagugcugggauuacagacaugagccaccgugccuggccuugaaaauuguaguuuauagccuuuaaaacuuaauucuuuuauuguuuccuuuuucuucuaaugcuuauguaaagaaauuuugauauuauagaacuguagaauuguagaagugcaaacuuccuguauucuuuccuuucccagaaacuguuauuuuuguuguauauuccuccagauuuuucuguguauguacugacauauuuuugaauguuaaaauguuuauacuuacuauuauacaaaauucuuguuuuauaaccuuuuuuucacuuaacaauguaucuugacuaucuuucuuuauaagacaugagauguguaaaacaucucauucuuuuaacaucuguuacaugcauguugcagaauuuauuaacuagucccauguuaaugucugaguugguuccauauuuuuacugucaaccaguacagcacugaacaccuuuaugcaaagagguagaaucuuuaacuuuauuuugguguuguugagacaaaguuucucucuugcugcccaggcuggagugcaguggugcaaucuuggcucacugcaaccucugccucccagguucaagcgauucuccugccucagccucccgaguagcugggauuacaggcguccaucaccacgcccagccuauuuuuguauuuuuaguagaggcaggguuucaccauguuggccaggcuggucucgaacuccuuaccucaggugaccugcucuccugggccucccaaaaugcuggguuuacaggcgugagccacugcacucagcccaaaaucuuuaacuuuuuaaaguaagugauacguuaacaugauuaaaagccaaaaguggccaggugcagugggucacaccuguaaucccaacacuuuuugggagacugaggugggagaauggcuugaggccaggaguucaagucuagccuggauaacauagcaagauuccaucuugacaaaaaacaauuaggcguggugguauacauguauaguccuagguacuugggaggcugaagcaggaagaucgcuuugucugggaguuugaggcugcagugagcugugauuacacgacugcacuccagccuggacagguaaugucugucaaaaaauaaauaaauaaagucaaaaguaugaaaaaguuauacaguaaaauuuacccugucuugcauucaccauauaguauuaacauaugcuauuacuaguuucuucuagaaaguuuuuaaugcuugaaugaacaaauacaaguguauuuucuacacagauacacuuuuuuuguuguuaaagaagcagcagcauacuauaaacacuguucaacaucuuauauuugcauuuauuuuaucuugaaggucucacauauuuguaaggagcuuccucauuuugaugguuauacaguaucccauuguauagauguacauaauuuauuuaaucaguucugcauuggcgaauauuacaguuuccaauuucugccagagcagugucauaauuguauccauaugucauuuuguacuugcaaguuuauaugugggaaaauuaauagaugugguacuacuggcccugcuagggguuugugcauaauuuagauacuacuuuucauagagguuauaguaauugaccaucucaacagcaauaaugaauuggagucccugugucccacaguuuuucauacaacguguaaaacaaaacuuuauaacuuucccaacucauuaggugaaaaauacucucucaguguaguuuuaauuguauuccucuucuuaugacugaguuuaagccugcuuuaguccauugagaaucuuuuguauaguacuauuucuauaaauucuauuuuguaauaacauuuaaaauauuaguagauauugccaauugugauacacaaaugguaagcaauaacaugaauauucucucauucucaccuacacuggauguuaaauaauugacugagaaauguauauucuugaguccuuuucuuuagcuaaaaauaauagucaauuauauaaugaaauaauuuuaaacaagucugauuucuaaugauguuuauaguaugucuuucuuuuaaaaaaugcaaaagcuaaauuuauuguccgauacuaacuaauaucccauacuaacauaagggauauugcauugaugucucaguuguuuagcuuuaucccaggaaaaaggguauuugaaaauauuaaauagguuccagucuuaguuaccugaaugauugguguuuuggaauauagccuuacccuuuagggauucucucuucaagcacaagugcacugcauucagugugcugacaauuuuuauaucuuguacuuuagaauuguuauagcuagaucuggacacauuacuucuuaucgauucugagucugugccauauuuaucaaauaaaccagaaaacugauggcacgugacagcaacaggcuuaucacccugcuucgcugugugucucuuugccauggccucuaggguuuuuaaaguggugcuguuucacucuauccaagaccagauuuuguuucacucuaacuauaucugccuucucucuucuucacuaugaccucacugaaacggccucccucuugaugcuuuaugaugacuuccuuaccaaagguucucagauauucaaccaagcaaggcagaaauacaacuuuguauuaaagcaagagaaaucugaaugcaguuguguguaaaacaugcucucaauuauauuugagaagaauaauuuuuuaaacaguugaaagauaaaugguaggauauuagcagcauuugcuucuagacuuggauuuagagcgguguuucauugacucucugugugugugcauguguauguucacagauuuuucauuuguggaccugggagggaggagcuuggaaucugaaaaaauucaucucuggggaagagaggucuauuguuuguggguacauguauaugugugcaaagauacagcugaaaagauucauuggcccaaacucagauuuggcuuuuugaguccagauugagcuucuuucuaacaaagauccaaauucaaaccuuaacaugguaaaaucuuuguuacuguaacguaacuuuuuuuuuuuuuuuacaauaauuauggaagauaaauguaugaagucgaacccagcauugaaacccuaggaaagcgaacauucuuaauuuuggugauggaaaaaaauaguaacauucaauaauguguguaucaucuuuagagaaaguucuguaaagaguuaauaagauccaaaguuguuuaacaguaaaaacuuuauauauauauuauauauaauauauauuuuuauuuauuuuauuuauuuauuuauuuauuuauuuauuuauuuauuuauuuauuuauuuugagacagcaucucacuccugucgcccagguuggaguacacuggagcgaucucagcucacugcagccucaacuucucaagcucagguguuccuccuaccucccuggguagcugggacuauaggcacacaccaccaugcccggcuaauuuuuuauacuuuuaguagaguugggguuucaccauguuucccaagcuggucucaaacuccugaguucaagcaauccgccugccucaaccucccaaagugcugggauuacaggugcgagccaccuagccccgccaguaaaaacuuuuaaacucauuugacaaagaggucugagcauguuuguugauuaaauaaggcaggccucucucucauagcuugaauacauuuuuuaaauucuugguaaguaguauuguaugucauaauuuuuauugcaggcuaagaggaaagaaaugccauguuguggaguaaaaauccagagaccuuucacugauuaccucugcucaccuauauugcccuuuuuuuuucaggugccugugcccccuuuauuuuacacaacuaugcaaauugugaggccaaggaugugacugcaaacaauuaagauuugauuuacaugaauaagcuuucuucuccaugaaaauacacugugucacuucacacuuggucuaacacacacacaaaauucucacccuagguggcacagauacacucagcaugcaauauuaaguacaauuuccauuuuauuuuucuccagagaauaguccaucuucagucuuuaaggacucagcuccuuacaugggcuuuggugggggucauggggcagcacccgcaggucuaaauugggguggagguguucgauccuucuccuucaugagaucgauuccugacuacuuuguugugaguugcacaacucacacaguaauauagcuucacauaacagcuugggaagcacauagacaucaaagacacucgcuucggaaaugucccugacugcugcgaccuucacuguguuucaaaugacgaauuucuuaauggccuuguccuugggcacgcaucaggcacgguucgugcagcaaacaggcugcacguggcuguggcccuuuuuggcacaaccauuguuccuucuuuucuuugucaucuuggaggccuggacuguagagaggacuguucccguuuuuuuuucuaacuuuugaaaaauuccauauaccuuugauuccuugcugauggaauaaguucaaauuuguaagguuaauaauuuugcauucauaaugauaaauuuuaauagagauuccaugcauuccaugaauauggagggugggagaacucuguucugguagucuugcagcuguucguagcaaacauacugcugaguuuuuuacuugucuuuuuuuuuuuuuuuuuuccuucagugacugaagcaaggcugugugacauuccauguuggagaaaaaaagaaaaaaaaaagcugaaugcucuaagcuggaacguaggaucuauagccuugucuguggcccaagaccuuggccuuguguacaaaaaugacaaaauauugcaauagcaaagcugaacaucuaacacuagcuaucucuugcuagaucuccuugcucagcauauaacuauaaauacauguaaaauuacauguauauggcuauauuuuuauuugcuugcuccuagaagagaaaaaaaaaucaacuuugaaucacaacuaggaauugaugcuuuaauuuuuggauacuuuuucagaauuuuuaauuuacuaugguccggccuaagauccucuguuguaucagguuuugugcacaaaagaaaagcacaaaaguugaaugcacauggggcaugugcuuucugugcaccaaauaucuggaugagguucuuuuuucaggccuacagucaaaucuguguccagaauuuuuugacuuuuuugcuuuguauaaucauagaauucauugcugcugauuucuauaaugauucauguugucaugugucucuuaauaacugagggcugucaguaaccugugauuuugccuuuucuauagucuuacucccaugaagaaccuugguucugauggagaaagugaaaagcuuuauuucuuccccuagauaucuuuauauuucuauuauauuuuuuaguuguguacuguguacuagagauuuuuuucaguuuguuaugaacacaauuugguaagcccuaaauugguucugccugucuccaaacagaaacaucuguacaaaucuuguugguauagacuacuuucuggaaaauggucaagauaaguucauguuuucuugaaauuucuaagauaguauaugguaucacuuguuuaaagcaaaucagacugaguuugacauuuaauucaauauuucugguauucaguaacggguauauauguuuguucuuccaguuugggucaguuuaaaagauauguugcaaaguauacauagaaaaugugagcaaugccucucuuugccuuuugaucagaaacuucagcagagcgguaaggauuccacaugauuuaaacugaaaugcuuuucuuuguugcuguaagaacuuaaaauguaaaauaccuuuuucaguuuaaguccuguaaacaacauugaagcauggagaugaggcaaggaauaguacucacugaaguugaaaugacugcccacuucaaaaucuucauuguguuuacacaccaguguauuuauacaaaucagaggcauuuuguagaugcuuugcugacuuguucagcucuguaaaaacacagaaaucagacccauuuuguaaagcggaaaaucauguuacauggaacauguccuguauauaucacauacaugguaauggagucuuaaugauaagugcaagauaauaauuuaaugaugggauuagucugaucgcuuaauaugcacaauccuggaagugaauuacuugcaucagauauagugauauuuauuauucuguacagagagaaaaauacauauaaaacauaugcuuacauuacaugcacgcggauuucaugcuccauaaucuuuucuauuuuuuaauuuaccuuucuguaaaugaugugcauggaauaugccuuauagaaaaaugcuguucauaauuugacuacguggaaaagugccuauauggugguaaugcuaguaaggcaaauaagacaaauuaucauguugguuuacuacaucaccaguuaacauuuuauauugugauguuuaaaaaagaaaaauuuauaccucaaauguguauuuuauuuuacaaucagcugugggguaugggguugggaugggagaauggggggguuggggagggcagguuuauucaccauagccgcugauaagaaucuucaaaaaaauucuauaugcgcacuauaaauguuucucuguuugccauuucugguaacuaucaugaacacagacaguuaacucuuucauaacugaauuggauagcuuuauuuuacagaaguauggcaaguuuacaaagcaauaucuaaaucuaauuaucauuaguugcauuuggacuaaaugugaugauauacuuuugcaauugauucuguaaauaaaaggauuacacuaaaauauuuguauuaaaagaagaaaagauaacauuuuaccuuuagauaacugcacuuguaccucacuagaguuaaucccacccaaucagauugagaaauaaauuggggaauguggaaagaguccaaaagaggucagaauuuggagagguacuggccuucuggacaacauuuagacccucuacaauuauuuucauuaagcugauuccuacauccugaauauucauguuuucucaucuacagauauuugucuucccccaaacuaaaagaaaaaaaacuacccuuuacucucuuuucuacucaguuacucuuuugugcuauguuagaaacuugaaauauauuggugauguggggauuuugucccugacugcccacuguacaggacaagagaguacaguguuucaguuggaauucaggacuccugguuuugagguagaggaugaucacugcaguacuugguuuggaauugccacagggguagcuaaaccaaaggaggguuauaucugcaagggagguguaagaaggcaaaauaaggaaaaggaggaauggguuuucuauuuguucaguuucaucaacuaauuuauacacuuaauacaacuucagugucaauugcuauuaagaaauuuuuaguugggcugagcugguucucuugugaaauugugcugguuaucuuuaagcuuaucaguuauuuguccaauuaaacacuuuucaccaguauuuaguccgaguuguacagacgauguauuuggauuuugucaugguucaucuacagacucaaaacauaaucauuuuaaaguaccuugggaguguguagaguaacuucuauaauagcuuuaugauccugaugauguuuuuuaaacacaauaaaguuggaucuuccauguuacaaucacagaauuaaaaccaguauuuaaaguggaaaaguauuaaaauauuauggacaaaua

SEQ ID NO: 192453 - RNA, 7199 nt, Homo sapiens
gugauuuuaaaucuuuaaucaaauuccaaagguuaucagccauauuacaugccaugauuagcuuucuauaagcaauuuuuuuuacuguguacagaucggugucaaugaaauaaaaaaauaaaacuguauacuaggcaaagaacuuuauuaaucuuuguuucaaacuugauucccaggcuucuucggcuuaauuagcugcaaagaaugaauuguguauaagcaaaaacugaaaagagcugcaguguccaaggggcuugggcuuaaaaauauuagagaucuagauuuuaucagauccauaaacaaaaauuucuuaaaaagcagucauaauauaaaauagcagcucccaguaacuucuucagguuuuaucuucagaaguugacucaauucaguuugccucauucuuggaagccucaucaaaauucuccacaagaucuaggaaaaggaaaagaguagaaauucuuaaaaaagccaaaucuacaaauaauuaucagauauuaaaaggggaugaaggaaagacauucauuugccaaugaugauaaauacugugucauagccccaagaacaagaaugcaaaaaaaaaaaaaagugaaaaaaaugccccccucuucccaucucauacauuggucaauagugggggagcagaaccaaagaauacaaugacacacaauguuaaaauuuuccuggauuccuaaggauaccugucuaugcaaagugggaauauuuaugaguccagugauucuccugcccaauaaauauuuuagaagaacguaaauuuauccaauaacagguaagagacaaaaaugucucaugauucccaaaggaguuaugcugcuacagauuuuagaaugcauauauauaucccaagauaccugaacaacuccacaccuucuuguaaauucaugaguuucaaaguagggagcaagggucauuagugcucugcagguaauaguuauauuuaggguacuauauauauauacuuauuuauucaauauuuaagguuagauaccuacacauccuugggaucccaaacagaaacaagccaagucaagucuauaaacauaauucucaauuaccuaauacugcauuauuuuucucauucuaaguaagaucuauguccaucuuaacuuaccaccccucuucccuggguaguuuuuccuacaaagauuucuuauucucccuugcuaagauucucuagguuaaccacaaguaaacguuccuaccuggaacuucaucaucaucauccucuccaguagcaaguggugcuuuuccauccacagcuaugaaaggaaaauguaaacauuauuugucuagguuuuuaauaaauauucaccaaaaaaaaaaaaaaaaaaaaaaaaagaacagaugaaaugccaaguguuguuacaacuuauuuccaugauaagggacauuugggauuuuaucuaugauacuaucaauaacaugauauucuaaugucuacaaauggguuaaaauacuaggaacagccaacaaacaaaauuccauacccauccuuucaaucccucugggccaccauaggcccugagguaguauaagggcaguagggaacucuuagagugcagguaaaacccacauaccaaaucauggugagauuuugggagacaaaugaagaugccauuuucucaacuacucuguguguggcauaagggugaugcucaacaaccacuuacugaaaugaaaaaaguuaaaguaaaaaaauuaaagagucugugagugguaagcauccacucuccuuuaucacacaagaauaugaacguacacaggagaguuauguacuaggcccauacaggcaucagugggauacuucaaaagccuauuucagcucugaaagcccugacaguuuagaaccugcaacucaaugugauaauaaaaaugaaaauugaggcagauuaagucaauaccuagaaaaacauggguaacuaaagagccauauauaagccucugacuuccuccugcauuccuauucuucaaaauuuuaagcacagaaaacagcauaacacugccacauccucagauguauauucagcuacacuauuuucugccccgaauaaaaucccuaucacacuguaauuaaaaaugccagaauacuggcaagccauuuuuaaaagauuacugguaauacgaacuauauagaugaaacugaaguaauuucauaauuuacacuaauuuuuuuuucaauuccaaacuuacaaguaguuauuggcaaagcaccaaauuaacauuuucaucauuucuaguuaauaaaguaucugauccaaaucaaguaaguagaaaacauuccacaaaaucaaguguaacaaucauggcacgcuacaucaauuacugcaaacuugagcaaggacaguugcuuaaaaucaguuacaaaucuguuauuuuuaaagcuugcauuuccaaacuuaaaaauacucauauccauucugagcccugagaucagaaaucagcugcuaaaugaguaauucccugguaaaaccauuacuaggaaacucacauuguuugggcagagcuucggccagucuccuuaaacuagucagacuauccgcaccaagcugguuuaagaugcuggguagcauuucugucagcugcuuugucucagcauggccuguaauggugaaaguguucgcugccagagaugccugaacuuuaggguuguuaaaguggaucacuguuccuugguuuguaaacauauucaccuauuaagaaaagaaaaauuuaaauuagcaaugcugaccagucucuuuaaaaacaaauguuuuauuaaacuaagucuggcuaacuaguauuucacugugaagcacaggugaaauuuugccuggaauggaauauguauucuaauagcauucagacuuaaugagcucccugauauuuauuaauuuaugguagaaacacaucuuagggacuuugaagucccuaaguuaaaaaaaaaaaaaacaacccauuuaaugcauuaacguuaacuuuucccagccaaaucuuguuuuuuaaaguaacaaaauuugauacuugccucuucaauaccagagauauuguuuaccccuaacuucuuuaaggagaacugaaguuuuuugucaucugcuguggcuguucuaugaaccaccuucuucuuucugcgagcaguucccuaaagucagggagaagaggaaagaaaacagcacauuuauaccacaacagauauuuuucaaaugggaauaguuuccaauucauuucugaccuuuggaucuguauaagaacauuaccauaaucauaaacuuaugcagugagcaggcaggcuaaggcgaagauagaagcaaaaaaugggaaaggaaaagaaugaucuuuucaaaguucuacuuuuuacauuugcucuaaaagugaucaaagagguagcaugugucaaucuaaauuaagcauuugaaagaauuccacauccagaauuauuaaccucuucuguuuuuuuuuuuuuuuuuuuuugagacagggucucacugugucguccaggcuggaguggcgcaaucucggcucacugcaaccuccgccucccagguucaagugauucuccugccucagccucccgaguagcugggauuacaggcaccaccaugccugguuaauuuuuguauuuuuagcagagaugggguuucaccauguuggccaggcuggucucaaacugcuggcgucaagugauccgccugccucggccucccaaaguguugggacuacaagugugagccaccgcgccugaccccuuuucuguuuuuauauuaaauaaaaaucaacauccaaauuaauauuuacaggcaagacaguguauggaacaaucaaaugaaucuguauauagacuucuauaggacucgauaguaaagucugaagcccuuaccuuaacuuacaagagcccuacacaaacuguccugcccuuaauaugccacuccugacugcaucugcuaccaucccucuucuuuagccaauaaaccuuggcuauucuuugaacaggccaagcaggcuaugacccaagggccuuugcacaugcuguuccucuccuuccggaacaucuacauggcucuuucccucacugcagaucucuacucuuaugucaccugaucaaaguggucuuucucaacuacccaaaguaaaauagcaacuuccacacucacucaucaauuucuuucuauccugguuuauuucucuucauaacacuuauuacuauaagagauaaauacauuuuaucauccaucuccucucccuagaauguaagcuccauaaggacuucuguuuauugcuauaaacccaguaucuacaacaguaucuagcucacugaaggcacucaaggaaagucuaucacacccaaccaccucaccgucccccaaccuccaucccuauuccuauucauccuuuaaaaucuuauucaagucauuaccuccuguuugccuuuccuaaauucugcaauuacccccuuucccuaugccaaaucauucccaucucuagauuuugaaaaugcuucuacuauuguacuauguauauuacacugugaaagaagauuuuuuuaagaaaagacaauuaucgccacugcuaggcuuaaagcccaccuagggacuuuaaacuucuuaaaauuuuauauucucaggauccaacauaguaaaggcuuaaauaaaucuuguuauuuaacugaagaaaauaucuauggcuacaaaaaaaaaaaaaaaguacugguuacuaaccucuccaaacuauuaaguacaaaaaucacuuugaaauggucauguauguaucugguuuccaaagaaaucuucucuaagaaacucaaaggaauuucuaagauuguaaagacaaacccagcauacuuucuagagguuucauacacuucacauauguagaguucaauuuucacuuaaauaauuauuauuaaugcugugauuagauaugaaaauaaagggcuuuuguaacauuuaccuaagagcaccuaacaccugcaguuuucucuaaagcaaaauuaacucaccuaauuucacaucccauaauaaguacguuucuuaaacaguguagaaauguuuccauauugugacuacagaaauacuucuuguauuauuagcuaaacgaguauuaagauguuaggacacaaaauuuaaucuuguuaucagcuuuaaauauccuagcaaaucucaagauuuccuuuacccuaaaaugaugucucccaaaguuaaagccuaaugaugagaguaacaacaaaaagacugcacauaagcacauuauucaaauuacuccuucugaaacuguacugaaaguaagagugguuaaaaacaccaauauaagagcauccaaacacugagacacaaaaaauuugaguuuugcuggcacuugaaggccacagucugauaacaauugauuaaagaggacaagaaacaucuaauguuguuaaauguguggguguggauccugaagauggcuaacguuaacaaaaauaaaaaguaaaaaaaaaucaggauaaauucaccgcuggcaaaguucaguaauuuaacaaagcuguauauuauuauuuaagucuaagugcaacuucuggcuaucucacagcuaacucuaaguuaaacgcuuaaaguugggaaaaacuaaaagguaauaaacauguaccauggaagcuuuacaaguuuuaccaaguaaagacaugcucuguuucaacaagcuaccacaccuuguuaaauacuaagaaugugcuaacaauacaaacuagguagaccucugucuacaguggacuucuuauuaauuacaggacaaucuaaaaaucagcuucaaaaaagaauccccuugaugugaaucaguauccaccaggaaaaaaacaauuaaucaaaaacugaucauuuaaaaaucagucacuuuaauucccucauuuuuacaguaauacaaagucagaacaggaaagauaccuacuuggguuauauuuucaaaucuaauagucacugcucuuaaacuccaaaauguacccguaucuucaaauacccuugaaauaugcaacuacccuaaagaauauuuaguucagaaagcaguacagaaaggucucaauuuacaagagagacaaacaagcacugacuuuagaaaacucaggccaaaacaagucaaggguaugaugugcacaacgaucuaacugaaaugacacauuuuccuuacuaauuaaauuaggaaacacuuuuguguucuacuuacacucuguaacacugaaaacacaaacauguuuacacaaaggcgauguuuuuagcucgucucacugaugugucuccaacccucgucucccccgcuccucgagauuugcuagcuccgugaauuucccucgauaggcaaaguuugucaccgauaauauaagaagcgcaaaaggaauauguuuuuuaaaauaccuaaaccuuaaaaaaaaaacccacaaacccgaacuauuaaaacuuacuuucccaccaaugcgcacuugugccugcaguuuggcgaguuuuuccugguucaugauuguuucuuucaucuagaaaaagaggaaauccucagcaaggauagguuuagcucacucuagcauuccaugcucguuauuucccaagauaccagcaggaaaauaaacguccuacacaggccgaaaccuggaucccaaauccaccccgcaaagcuccaaauuuggguuuccagggagcccaaagagcacccgccuccccaccacucccccacagcuccccgcucuuggcaggcccggaugaaaggcucuaccccacgccuggccagcaccccccaccccuggcccuggccuggccucggccuagccagggccugcccggcccggccacucuccgcaagccucgcgguaccugaggcuccuguccucggguuccgccgcgagguggagguugagacagcgucgccucgcccccagggcagccgccccuggcucgaccucgcccccgagagucagccugagcgggugcgccuguccgucgcaucgccuuccucuccuccucugcccugucccucccugucucgcuccuucagggaacuucccgcccccgcucccguccuccuaccacgccgccguccagagccuuuuuguaccuugucggagcgaauaaggggccgcgcgggggacuaggguuggugcucaaggggucucggguggaccaccugagauuaggcgcacacacgcggggacgcaagauggcagcuaaagggaggccggaagugacaca

SEQ ID NO: 192454 - RNA, 134542 nt, Homo sapiens
uaaauuauauauuacauguuuauuaagagcacaacuuuuauguaaaauuuacauuuaaugaaaaaaaucaaaaauauuuacaaaaucuuggaagacagaugugcauuguucuaauuacaauccaaaguaguaaauaacaauccuuuaaaacucacauuuauuagaguuguguuuacaaauucuugguuaaagaggcagcuacaaaguuuaucacuauauauaagcaagaaccagcuugcuagguacauuucccauugaaaaucuacuggucucuuuuacaccauuaguggauuuuuaaauggaaaaaaaaaaucaauauaaacucauauggcuucaaaauuguaaccuguacccaauacuugguaugaagacugugguaacuaagaaagugcagaaguuuaaccauuucacuaauuuguacauuuuuagguaauauuugauuaaaaacaaacacgguaagaacagugucugaauuccaauaauaaaauauuggcugcccuaaaagcaguuugauugcaaagcaaauuacaguuagaauuccaguaagggacuguaauuggcauuuaaaagagcacaauauaagaguuagaaauucuaauuuagcucacuauuuaguaaagauuagcauuuuagcaaauuaucuuaugugcugcuuuagucaaauguaaauucagacuugggcuaacauugaauauauaaaaaagcauauacuguguuauauauugcuaaagaguagauuuucugcuguauuuaguacagcaagauguuacauaaaugucuaguaauagagguuuuauuuucugugaagcuuaacggaacaauuagugguuuuauauaaauuaucauauauaacacaauuuaucacuucuacuaggcaaauaaaggacacucauauuuauuauuauaaaugaaauucccauuuguaaauuaugaaaccuuauccgaaauauuuuauuucuucaauuaaucaagauuugcuacuaaaguuagguuucuuacuauuuaguauugguaguuuauuuuuagaaauguuuaaccaaauauaucacuucaaauaauuucccuauuuuuacaaaguagaaauugaauaauuaaaauguacaaauugguaauuuuuccaauuguugaaauaaaaacaaauggcagugcuucuccuucuguuuccaaaauuaaucuuuuaaaaaaugcaucccucacaaaauaccauaaaacucauguucacaacacaaucaguaaauaaaugcauaaauuuucaaugauaaaguaucaaggaaaaugcuaaauugagaguuaaaauaccaguuaccaauuuagcacuauaguuuuuuuagaauuuguuuuaaaauucacacacuuuugaugagguuaaugucaaguaucugaagguaaucuuucuuccuguaaacacaugccauuggguuuauuucucuuucuaguggcuacaguguaucaccaaagaagugagccaggauucuuaaguuaggcuuuaugacucugaauccccuucccaguugcaggccaaaaauauuuacaaaaauugcaaauaucuuauaaaaaugcuugaucacuguaagauucugaacagaagauucagacugagaaaaaaagugaggcacauuaaugaacacaaauuguauaggcacaucucugguuuuuguuauuguuuuaaaaggcacacauuaugcaauuccauauaaaaauaaauuaaaucuacagcauuaauucaucaaaaaaaucacaacuccuauaaaguuaacuaacugcagaaguaaaugucucugcugucauuugcaagcuuauuuuaaaacacauugcacuugagaauuuuuuuuaaaaaucauauaaaacaucacuuauacuuuauuaauauguuuaugagaaucaaauuauagauuuuuugcauacaacuuggacucuggucugauuaccuuauggcacauagcucaauuugauuaaguguucugaguuaacauuacccaaaacuuagaauucauguucuauuuguauccacugaauaucaaacuuaugaaauuucaaaguuaucucugacucuaaaaauguauggaaagcuaaauuacuuugugcuugcucuucugaaacuuuaggccugauauuacacuauaacccuuuuuuucaacauagacacuggaaauaauuuaaaaauuaauccuacaaaaacuucauuuuuacugagaaucugaauaaaugugcuuccugaauauuguaguugaucauuuacaacauagagaaucauuucaguacuauuuauuucaaugacucacuuuaaaagugcgauuuaauguuuguagucagcucucaaauaugucuaaguuugaaagacaucauacaaguuaaaauaguguuuggaaagaacagauaaugcagaauggcagguuuguaaucccugaagccacaucacuuucccagguccaucaacaauccgccagguaucguccugaaaaacgccaagcagaccuuugcaauuacaauuucaaaugcacucuaaggacauuuuccacugugguuaccaauacaaaacucuaguucccaucugcuauuuacaguacauuagaaucagauaacagguguucagcuauacugaccguaagaacucucucccaggugugucucuaccuggcaccuuguaccaaggguuaaagaaaaaauuuccaugucuuuagauuauaaauugcuugacaguuuuuuaauaacuguuagaauacaaauguuucccauguacauuaaaaaguuugaaaucuccuaacuuaccaguagcaaaccgcuucuuuauuaaggaaagccuauagccagugcccacaaguucgaaaucuacuccugaaaggguacuucccucgcugaggaauuguacugcaagugucguggguuuacuagguccuucugaaagaucaaauuuugcucggagggacccagaaccuacaaagaaaagaauaaagcacuuacacaggguaaaauacauuucaaacaaaauagaaucaaaugagcaaguaagcuaaacuacaucaguccugugcuacauucauuagaugugcacaguaaacaaacuauuauccuguuuccaaaucucauauuuuuuagugaauaucaauuuucauuaaguaaauaacccaugcuuuucuuugacucaauacuaaucuucagagauguuaacuacuggacuccuaugcuauaugcauguugaggcgagucaaaagagaagaaggaaguaacugaggacagcccagagaaaaacccuaggagggauauagguggcauaaaguuaaaaaagaaaugacuacugaguaguagaagaaguaaagauggaaagguaacuacgguugggaagaguuguauaacauugcuauuuucuauucacuuuucuuuuuaaaguuuuacuggucuaacauaaugccaaguagguauuucugagguguuuuguuucuaguaucaucaccauuuauucaguauacuucagucuaauggaauggcaggaacaguaaaccaauaauuauaaugaauauuauaaaugcuguaaaggagcucugaggagcuacaggcacaaaagcaccuaucucagcugaaaauuauaaauggugguggggaugaugguguguauuuuaggcagaaguuaccaaagauacagagacagagcaugaugcauuuaacgaaauagcaucuauaucagauuagcaggagaacaggauacagguagaggggaguggcagaugagacuagagugguagcaugggccaggccaugguaagaaauucaugauguaaccaugggaagucaccaaagauaaggaagacaagaacauuucagauuagugucucaaaagggaagagaagcacaagaugcaagguugggagaccaacugcaagucaaaacaguuuaggacucuagaugauaggaaagggggaucugaacuagggcuaauaaaaaggaaagauauuaagaaaguuauuugaaagauauuuaggaguuggaaucaagaaaugagaaaggaggagucuaggaggguucccagguuucuggauagagcaaauggacagaaaugcuagguacuagcaguaagauccugugauccccugcacagaagcuuaacacuacacagagaaauggagaauaggaugucacaacauugauccaacuuguauuauuaugccuggaggcauagaucaguaguggagaugaacugcugccuuauucuuaauuacuauccaggcccucaaacuuuuacaauucuugauaaccaauuugguugugcaaaaguucuaccauagaccaagagcaacaaccuugacaaucaccuuagaaauauuuccugucccucuucugaguacacagucagcaacagaaaacagauuucuauuuuacagaauuuuuuguguuuuuuuuuuuugagacagagucucucacucuguugccuaggcuggagugcaguggcacgaucuuggcucacugcaaccuccgccuccuggguucaagcgauucuccugccucagccuccugaguaucugggauuacaggcgcacaccaccaugccuggcuaauucuguauuuuuaguagagacaggguuucaccauauuggccaggcuggucuugaauuccugaccucaugauccacccgccucagccucccaaagugcugggauuucaggugugagccaccgugcccagccuauuuuacagcauucuuauuuauuuauuuauuuauuuauuuauuuauuuauuuauuuauuuauuuuuugagacagagucucccucuaaggcccaagcuggaauacaguggugcaaucuuggcucacugaaaccucugccucccagguucaagcuagacucgugccucagccuccugaguaacugggacuacaggcacgugccaccacacuugguuaauuuuuguauuuuuaguagaggcaggguuuugccacauugucuaggcuggucuccaacuccuggccucaagugauccaccugccucagccucccaaagugcugggauugcaggaaugagccaccaugccuggccuuggauauucuuuucaaaggcuugacuaaccacaucaaaaaccacauuuauaagauuuuuccauuuccucacagaaacaccugauaccugaauagcagagggaaacuuaaaaucugguuagaaaauuuguaucucauuuuuuuauuuuuugagacggagucucugcgccaggcuggagggcaguggugcgauguuggcucacugcaaccuccaccucccguguucaaacaauucuccugccucagccucccgaguagcugacacuacaggcacgugccacuacauccagcuaauuuuuguauuuuuaguagagacaggguuucaccauguuggccaggauggucucgaucucuugaccucacgaucuaccugccuuggccucccaaagugcugggauuacaggcaugagccacugcacccagccugugucuuauuuuugagagaacaaauuucuuucuuguuaauuauuuacaauaguauaguuucauuauauuggggaaaaagauccuuuuguccuucuaaacugguuauaagcccuuaaugcaaacaggauugcugguuuacuucaauuuaaacuaggaauuucagcuuggcucacaaaaagcuauauauuaauagcuaggguuaaagucaaugcaguuggccagcugaaagugggcaaccuauaaguaccaaacagcaaaaaagaaacugaagauuugcuugguuauuucacccaauguauggcucuccaguaaaagucuuauucugcauggcagguguaaaugaauaaacaacacagacauauuuacgguccuuucuacagaaauaucuaugagaaaagcuacugauauguuuuauauuaugcucaaaauauucaaaaagaaaaagcucagcaacauuugaaaagccaaaaaaccuaucaaauagaggaguuauuggagacuaggcugagcaugguggcucaugccuguaaucccagcacuuugggaggcugaggcuggcagaucaacugaggucaggaguucaagaccagccuggccaacauggcgaaacccugucucuacuaaaaauacaaaaauuagcuggauguggugguaggugccuguaaucccagcuacucgggaggcugaggcaggagaauugcuugaaccugggaggcagagguugcagugagccaagaucaugccgcugcacuccagagugggcaacagagcaaggcucugucucaaaaaaacaaaacaaaacaaaacaaaaccaaacccuaaaaaaacaagcagaaaaguuauuguagacuaaaauuaugcauucaaaagaaggcagaagaauucucuuuugauuaagagaaaauaagacuauguuaaagacuuggcugucccaagaauuacauccuuauuguaaguugaguuauagaagugaucagcuaggacagccuuuuccuuggcauuaugaacacaaacagauguacuuagugagagaagcauaacuugcuucuccuuaaaauaaucaucagaaaauugaaugcugcugauaguuagcuuuaauagggggaaauggacaggaaaaagguucuuuuagagaacugcagaaggcaagggggcuuuuuuuuuuuuuuuuuuuugagacagagucucacucugucacccaggcuggagagcaggggcaccaucucagcucacugcaaccuccgccuccuuggguucaagugauucucaugcuuaaguccccugaauagcuggaauuacaggcgugcaccaugacgcccagcuaauuuuuguauuuuuaaaacagaugggguuucaccauguuggccaggcuggucuugaacuccugacuucaagugauccacccaccucggccuaccaaagugcugggauuacaagcgugagccacugugccgggacggcaaggggcuuuuuaaagccuggaagcgucuacaugauuucugggaggucaggagaaucccguuaacagaaugaacuaaacuguguuaaaucaguuucaauuaguuaucagguuaccuacauggaacauagaguucuauuucuuuaaauuuacuagguauaguuucuuaauguuagcauguaaauauaagaaguauuuacauaauauuuauaaaguuauggcaaaauaaauuuuuucuuauagagaacacauacucaaucuagaugaacaaauguguucugaaucucagcugguccauucuaaagguauuaacuuccaccuaguggucauuucuagaacugagggcaugaaauuccaggaggaaacuuuacauaaacuuucccuuaaaaaagguauugcagugcuuccaggaacggugcacccauggccaggcgcaguggcucacgccuguaaucccagcacuuugggaggccgaggugggcagaucacgaggucaggagaucgagaccauccuggguaacauagugaaacccuguuucuacuaaaaaaaaaaacaaacaaacaaaaauuaguugggugugguggcacgugccuguaaucccagcuacucaggagucugaggcaggagaaucgcuugaacccagcaggcggagguugcagugagcugagauuguguuacugcacuccagccuggcaacaaagcuagacucuguuuuaaaaaaaaaaaaaaaaucaauuuucagugacaucauuuuauaaauaaaaaaggacacacacacuuaccuccauuuucugauuuuucugaaauacuagacaauuuccaaaaggcuuucauuuguucugcauuccugcaauaagaacagauaucuucagguuuugugucuaguauaguaccugauacaugaaugggaccucaauaaauaaguguauuuuaaauauuuucacuacaacaaauauauugcuaaguuuaaguaguauuaacuggugaaaauguguuuaugauauaguauaaacauaaugcuguaucuuuuucaauuaauggaaguuuaccaaauuauguaauucuucucauuccuauuggucagagaaaguaaaauggaauguguauagggaucaguaccuucauuagucaaggaagacacauguuauuaaaugaugaaguaacuauaaagagcgguuagagucuauacuaauacuaacagaggggacaggagaaguugcuaagagauggcaguaacuaauacuauuaaacacuaauuagauagguguuccuguuccuauagacuugccagaugcuauauuuaauccauaaaauauuuguauuuuuuaaaugaaaaaaaaaaaaaaagaaguuuagagaggucaagcacucugccuaaugguaaaguuaguauggaaucauugaagucugggugguacuuagagcaaaacuaguuuuguuuauuuuugauuaagguuacuaugguuugacuaguaaaaugaacugcaucuuuuacagcgugguuucuauggaaaaaggcacaaaaauuuuucaaacuucuaagaaaacuuacagaacuuggguucuagaaguuggggauugcaacaaaaauuuagugggaauucagaaacguauguuuaauuuaccauauugcagggggaagggacugcauguucguuacuccuccauccacugguaccaccaccuguauguuggaaagcacacuaggugccaccauagcuucuggauuguauuuauaauccacucuaagaucuguggugcuagcacuacauuuccaguauguugcaagauucagaggaguggacugaauaccauuugaugauaccuuuaaagagaaaagaacaaacaauuguuuuuggccugaaaaguuaagaagucauguuaaugacauggacacuugaacauguaaguccacaaaaucaaaaauaucuaaugaggggacuaucuguuggcagagugaagcagaccuaucucaaaggaguaaggaucauucucaauguggggaccuacuacuacuuacaucaaaauugcuguggugcuuguuuauaacacacauucccuuagcuccaacugcagaaaaucugauucaacagcuuagggacagggcccagaaaucagcauuuuaugaaggaauucuuaauuaugcguguaaaguuugcgaaucuuccaacauucaacacagaauucaaagauucuucauacauuauaagaauucagauuuagaacacgagaaaaaaggucaccacguaguaccacaaguuggaauuagaaugcuuccaacuucaaauguuuaaucacaugacucacaguaaauguuauaauuccuucaaauucuuaagcuccuuguccaauggcuccuuuuuaaggagaccuacucugacugcucuguuuaaauuuacacugaaaacuguauuuucaaucuuccuuaccuuagucuauacuuuuucuuuuuuccauaccacucauuuucuaacauagaauauuaugauuauuauuuugaggcagggucucacucuguugcccaggcuggaguguaguggcaugcucauggcucacugcagccucaaccuccugggcucgagcaauccucccuccucagccucuguacuagcuaggacuacaggcuugugccaucacacccagagaauuuuacauuuuuuguagagaugggguuucuuuuuauugcccagacuggucuugaacuccugggcucaagcaaucuucucgccucagccucucaaaguacugggauuauagaccagagcaacaaaguccagcccauagaauauuacugaucuuuacugucucccuguccuacucccagcaauuacaugcacugaauaauacacaucuguugaauaaaugaacaccuguaagaaacuuuaagucaauuuaaguggcagcacuuuuuuguucuuuaaguauuuuucuagaaacaagccauuuuaauaaaauuacccuauuaaaaacuaaaaaaauagagaaauauaaaguaggaaauuuaucccuuggaauccuggcauauauccuuccagacucuucaggcauaugcaaacauagauccaugucauucuuuuuaauggcuauaguaauuaauuuccuccucugcugauguguauguacuuaggugcuuucuaaacaaugcuacagcgaauauccuuuaugccuuaucuucauccaacuguguauuucugaugauuucuggaaguggaauuguugaauuaaagguuacaucuuucaacaaucuaacagaauugccuucuaagagguuuuacuugcauccuauuaacaagugaucauaaccuucuuaauacuggauaaagcgaacuuucauuuuuguaaaucugaugggcuaaaacugacaccucauuguuaucuuaguauugacugcucucauuacuacugacaugaagcaucuuuccauagguuauuugucuauugaguuauucacauguugcuuacaaauuuacaagggcucuuugggguaagcccugugguucaucuuaugugucguaaauacuuuucccacagauuaaauacugauuguguuuaaagguuuaacaaaauauuuuauaaacacacacauuuauuuaucaaauaucucauucucuucuuacauggcuucuggguuucauaucauacuuaggucuucuguacuucaagauuaaaauauguaauaaauauguauuacauauauacacacacagagaaauacauauacaguuguuccucagcauacuugggaggguggguuccaggaccccuguguauauacuaaucugugcauacucaagaaacauaguuggcccugugggacccacauauagaaaaaguuggcccucuguuuauacaugaguuuugcauccacaaucauugcauuuucaauugguguuugguuaaaaagaauccucguauaaguggaccugcauaguuuauagauccuuuuuguuuaagggucaacuguaucuucacccaugccuuuauuuuaguaccuuuaugguaugguaucuuuuauuauuauuauuaaaccuuugauacacauggauuuuacuuuggcuaaaagucuaacagggauucaccuuaauuuuuuucucaagugucuagcuugcuauccucaacaucauuuuuugaaaaauucaucacguccacauugccuugaaaugcuacuaugucguauaaacaauuuuccauuuauucuuagaucuauuucuggauacucuaaucuauuccuucaucuggccaucuacugcugcguuaguuccaaacuauuuuaaauacugucuauacuaagcuuucccauuaaagcuaaaacauuacuccacuuuacuguuuaaaacauuucuugccaggagcggugguuugugccuuuagucccagucacucgggaggcuaaggcuggaagacugcuugagcccaggaguuugaggcugcagugaaaugugaucaugcuacucuacuccauucugagcaagagaaugggacuccaucucuuuaaaauaaaaaauucuugacuuauucuuguaagcuuuauucuucuagagaaacgugaaaaugauugucaagccuccaaacacaaagacguaacucuacuggguuucugaucaguauuauauuagauguauaaguuaacugagaaacagcuaaacuucuacagcaugaaucuuuccauauucaagucacuagagauuguguuguguuucuuccuaauuguucuuugugaauauuuuucuccacuaguuuuuguaauugguuuugaaaguuauuaauuuugguauuaauuacuaaacugaccaccuauauuaaauguccuuaugucaaauaguucuucaauugguucucgugagaggaauauaucaccuguaagcaauaauaauuuugauuccucuuucccaguauuuauuaaugcuuauuuuguucucuuaccugacuguacuggcuaacacauccagaaaacucuuauauacuaacaggaucuacuaaugggcaucuuugccauuccuaacuuuaauugauuacuuugggaguuucauuguuaagacugauacugcuagucuuuucagcuuaaggacaaauuuaugcauuuaaauuuacucaguauuuuaaucaugaauaaauggugaauuuuaccaaacuggucaaaaucuccacuggcuuauaaacagauuuucuaauuucaaaacauccuugaauuucugggaaaaaacucacuuggcuaugacauacuuauucauuuauaugcuagauuccauuuuuuaauauuuuaauuuagaauuuuugcaaugucgugacacucaccugauacuuuaauacaucuacauuauaauaagaagcagcuggauuuugcucugacagcuucuugagguagacuguaacagcuugcauguucauccaaaaaucuuuuguguuggaaucacauugugauggaucacuacauauauaaaaaauauauuuguuauuuuauugacuuaucuuuauguuuugccucuguguaguaauuuggugacacaggaaaaacuaguagaaauaaaccaagaggugggaugaaggaaaauuagaucaggggaugaagaauggaacacaggagaagcuugcuugaaagauaagauggagagagagaaaagaaucuuaaaauaacuauuagcaccacugaaaacaaaauaaaaagacagcagaaagguguuuaguaagaauaauuuugguaugguuuucaaauugaauauuauuauuucaaagaagaagggggaaaacauuuuuuuuugagacagggucuagcucugucaccaaggcuggagugcagugacacgaucuuggcucacugcaaccucugccuccuaggcucaagcgauucucccaccucagccuccugaguagcugggacuacaggaacgcaccaucaugcccagcuaauuuuuguucuuguuuuuuguuuuuuguuuuuuugguagagaugggguuuugccacauugcucaggcugguuuugaacaacugggcucaagcaauccaccugccucagccucccaaacugcugggauuacaggcgugagccacugugcacagcaggaaagaaaaucuuaaaacgaaauuucaaccuucaaaacaaaaaguacacaaaccugaacacaagcugugcauuuggaagaaucugcucuagucugcugauauuuuucacccugaagcacaacacagcuggaguuggauugcuggugaagacuuuaauaauuccacuuggaaaugacauugucauaucaccagugaucuucacaauacaccuaaaacagggauuuugaaaaguguuuaaauaaaaugcucuaaucucuauuuaaaguauuugguuuaaaaaggcacacgcgugcacgugcgcacacacacacgcaccuauauguguguauaucuauauccuuuaucauaacuauagauuauuuuuucaauuuaauuuuuaaaaauuauauacaugaaauaguauacucaucuagcaucaucuuuuccuggaauuaaacucuaaacacaaaugcaagcacacugauaauauuccuucacuuuuuugugauaaccauucccucccuggaaggauauugcuuuccucauaacgcuauaccuaguuguggcuauuuuucccucccaaaccccaaaaagcacugggccuggugauggugaugguagcaaggaggcccuugcuccucauugcuucuuccaacccucuauucuuucuuccuuugaaacauauaacuacauagccaaaacucucaacuggaccccuuugguaauccuaucacauuucccaagucuauuuauucuucuuuuggucuuuuccuagcuuccccuuuuaucucuaaccugcaauaguccuucccccaacucuuagcugaugacugugcucuucauuucacugaggaaauaaaaaaauaacuuccucauacucucacuaguaaaucuaccuaacuuuuuauccauauauucugcaguccauacuguuucaacagauaaucaauuucugcaccucaggccaaucccagcaauucugcacuggaacucaucugcucuuauauacugaaggacuucauucaugugauuguucccucuuuuuucugcaaguccuguuuuuccauaaauaauggaucuuucccaucagcaggcagacaugcugaaauauauaucaucuuuuaaaaaacacaaaaaugaaaauaaauaaaacccuccuuugauuccaccaccucacuccugcuaccauuccauuucucugcucccacuuagaccaaaacauccugaaauaacugcauuuguucuuuccaaauauaguugucuagacugcaucaccuucggcuccugaacacucucaaagcauacuuucaucuccacuaugccacuaaaauccuucuugugaaugucaccaauuauugucaauggucaauuuuucuugaccugucaagcagcaucagauacagguucacaccugccuucaagaaaugauuuauucacuuaguuucuagacacgggucuauugguucucuccucaccucucuugcugcuugcucucucaaauuccuuuguuaaaucauucucaucuuccuguuuucuaaacacuggagggaaucaagacuuaguuuucagaucucuuuuccaucuauuccuuaaggccacuaauuuugaguauuaucuacaaacuaauuacacuaccaaguauuuuaucucuagccuagacuuaccccuugaacuccagaaucauguauccaaguaucaauucaacauuuccacuaagaugucuuaaacuucaaacuuagcauuuugccuccaacaaaucuugacaauucuguucucaaaauauauucagaaucucauuacuacucaucaccugcucugcuaauacccuuauacaagccaccauuaucucucaccuggacuucuguaauuaauuuucuaacuuucucucugcaucaauucugacugcccaccgcacccucugcccccaguuuauucuccauacagcaaccagcgcuccucugaaaacacauguaauuucaucauuccucugcucaaagccuccacuggcuuuccauguuacucaaaauaaauuccaaauucuuuaucauggccuacaaugccuaaccuggucucauaccucuccggacucaucuucaaguacucuccuguuuacuccuacucagugacaugguuuugcuugcuguuucuugaauauaccaaauaugcuuuuaccuugguaucuuacacucacugguucccucuuccuggaauacuuuccucagauaucugcauggcuugcuccuccaugucuuucaacuaccugcuuaaauuaaccucaaaaaaguuuacccugaucauucuaucuaaaauaguagcccucuaucuaauguuauucucuagccucuaacccugguuuauuuuucuucauagcguguaucaauauccaauacauacagcuguuucuuugauauuuaguuuucccucacuauaaugcaagcucaggagagaacucuuuuguuuacuaaaguauccucagugcacauguaacagagucuuagaaauaauaggugcucaaguauuugaugaaugaauguacauugaaugcaaucaucaaaugacuaccuuagauagcaaaaaagcagguaaauaaacaacagaaaacuguaaucuacacagaaucaaaauguaauucuuaaaauuuaccaccaagccccaccaccuccuccacccaacacacauacauacacauacaugcauauauuuuaaaaacuaacuuggugggaucugcuccuuuaaaguaggcauuaacagauucuguaagggcaacugccacagguaagguauccugauuuccaaggcugacagggcugggaccccgugacacaccuagaauauacacaauuaacuuguuaaauccuucagaaagacauaaauuaaauaucaagauaguuagauucacauuguuaggcugucacaaacgacccuaccacugguuucagugaugucccaugauaaaucugggggcuaagaaauauaguauaaaacaaacuggagcauuaauacaaaggacaaaaaaaaaccaggaagacaugucacacagacauuucuuuuaaauggaaagacagaaugguuaaggaaugucagaauaaaaaagcccuugacuaaacagcuaaaauuucaaaaauauuggcuucaaaaacauucaaauaccaaauuccuccagguucuaucaaucauauacuucagggcauuauuuaaggccaauuuaggauuuuuguauuuaaguuuuucuauccaaguaguaauguuucauacacuacucauuauuauuauaauucucuuuaaccuccucuuugucugaugcuuguauuguauucccacauuacuuugccucaauauuugacuaauaaauacuugacuaauaacauuauuuaaaaaaaaaaaacccuggccaaaguucacucagauaagacaccuuuuagagucaaaucagagaaagaucagugucuacagagcaaaauuaaaauguaaacaaauuuaugcaaguguucagguuucuguuuauuguuuuaaauguaaccuaagugaaguauccccucaaaauagugcauugccuuuguuuuucuucacaaacgcacucuucuuaccacugcgugccuuacugcuacugcuacugauuuuccaaagugggagcauuucauuuaauaaauaaaaugcaauuuuauaaaaauauaugagaguuuguuauaauuauucauccuuagugaaaaaaauaaauaaucuaggucaacacuuaucucugaaauuugaauauaugcuuuccuuauauguuacacaacauuaacagccaucagacauuuuuauuucagaugcgacuccuguagugaaacaaugaauuaccucugagauaccguaaauauuaauucugauaaaaaucaguacuggcuuuuucugccucacaacuaaaucugagaugcuauaaauagugaaaaaagauacucuguuagcuugguauucuagauuuugaaggaauuuguauuuagaagcuucuucacaguuaaaaaguuauucaugaaaucacaacagcuacuauguauuaaccaccaugugccaggcacuuugcuagggggacauuuaaaaaaaauggugccuuuuugaagcacaaguacuaguuuugcaaagcagaagcaaaacaaaaaaugugagggagaggcuggagugacaaaaagacacaaagaugaggcuggaaaagugcucaugauccagauuaggguaugaaagaccuuuaauuuuauccuuuugucacuagaaaccacugauaauguuugagagaaacauuauuaggcuuuuauguaguaagaucucucugaacacagaguaaauccuagauugaagggaaaaaugacuguuggcagggaaucaaguuuggaucaggugagagcaguuaggugaaagcuaguggccugaucaagugucauuaguuuugggaugcaagaaaauaucaagugaaaaaaagcugauuaaguauacauuuacugauuauaaauauaaaaauauauguuuguacacuggaaaacuucacuguaaaucuaacuuaguucaauccacuuuuuucccuaauauauuguucuaaacaagagggucaucagaaauucaggaaaacauauuuucugaaaaagacaaaggcuguaauaaucuuuucucuccaauuuuguaacuguaguaaaauaaacuuaacauaaaauuuaccaucuuaaucauucuuaagcauacaguucaccgguaugaauuauauucauaacgcugugcaacaaucacuaucauccaucuccauaacucuguucgucuuauaaaacggaaacccuauacccaugaaacaacaacucccaccaguuuccccagccccuggcaaccaccauucuacuugcugucucuaugaguuugacuacucuuuaaguaccucauauaaguggaagcauacaguauuuaacuuagcacaaugucuucaagguucauccauguuaucauagcauguuagaauuucuuucccuuuuaaggcugaauaauauucuauuguaugcauauaccacauuuugcucauccauucauccaacaauggacauggcuugcuucuaccuuuuggcugcugugaauagugcugcuacgaacaggaguaaacaacuaucucuuugagguccugcuuucaauucuuuuggguauauacccagaaguaaaauugcuggaucauauguaaauuccauuuuucauuuuccgaggaacaaucauacuguuuuccacagcagcuguaccauuuuacauucucaccaacagugcacaagccuuccaguuucuccacauccucaccaacauuuguuauuguaauacuauuuuauuaaaauuauacucucuuaaauaugaaauuaauauauucccugaccagguguacuggcucaugccuguaauuccaguacuuugggaggcugaggugggaggacugcuugaacccaggaauuugagcuuauagugagcuaugaucauaucccugaauuucagucuggacaauggagugagacccugucucauuaaaaaaaaaaaaugucucuugaguaacucacacaaaugaauauuuauauaaagucaaugguaacauuaaugucuacuacugcuuugacacuaaaaauuaaaagaaaccugcauaaauauucuuuucaacaaucuaaucugggcacauaacacgacucuguaaauuauuaugccuagcuucccuguaaauuaugccauuacugaaacauuggcaagcagagaaaaguauuggaaaguugaagaaaaacucaaaacccacuuaacaguuggcauauucccuuucguauuuucuauuuuuguuuuucuuucaagaucguauugcacauggauacuucaaaaaaugaauaggaaauauguacuuaaauagucuuuuaaaaagucuaaaacuauacuguauuauuccaaauaaauaauuucuuagaaauaaaaauuuauucucuuaauaaggguagauugugguuucuaauuuugguuuguuacauauuuagauaauuuuguuuugaaaauguagagagcuuauaaacuugagguauguaacagguauaggguaccuucuuauaacaaucaauggauauuuauguagaauuccuuuccgcucagaaauaaaacacagacacccacucccuacuaucuccuaucaucuccaugcuucuaacuucaucuguaugguuuucguauaugacagccuuugcccuacuaauuuagguauuagagguuuuuuuuuuaacugacauauuccuuuuaauucuuuuuggaugacuucuuaccugauuuggauagcuuuagaauuaagauuuauugacauuucuuaaagcugaguugaggaaagcagagaagaaaaugcaaaaauaucguguuuuuauaguuggggauuugauauaauggauccuauucagcaaguuggggauuugauauaauggauccuguacagcaauuugauggaauuagcacaaaacugaaauaguuaaucuuagcauaauucuugauuucugagacaucauacaauucuggaaaaggaaaaguuggauaacgaaauauuuuagauacacuuaaggaccauuagucaacacauacauuugcuucugauacaauaccuggugacgucucacagugcuuuucaauuucagugugugucccaaucaaauuaucaucuucuauuguauuuaaauaaaauaaugcagaaaaagaaaauauuuucaagaaacaaggagaaucagaaacuuaaauccacacagcguugaaaaaucauggcaaagaaagagaacuuuuuagguagauuuuaaaaaucuuuguuguauaaaauucacauacaaccugccuugccuguauuaucacugucaccugcuuuugguuguccuauugccagcaaugucucaaaccauaaacuaauauguaccaauucaauagaaauuaaaguuuccaucacaaacacaaaaccuccugaauaaucuaaagauaacuggaaaaaaaaaaaaaaaaccuaaagcgaaaauaagguuacccagaccaccugccugcuuucuaguaggucccaguuagguuuuuuaggacuaaaauauagauucugugggaaaaaauuaaaaccacacaaacaaaaaauaaaaaugaaguauucauuaaaccaaagggcaaacuuauuagacauauucaguuuauauaaaauuaaaagaugggaaaaaugcuguguucacaaagguaauaagauggugacaucauguuuagacauuuagaaaucaagccauuuuauauuucauucuagccuauauuacuuaucgucuuuuuacaauggccacacacuaguugcauuucuccuaugugagccuugacaaaucaacuggaauuaaaucagcuuaauuagggcugugguuaucaaacuuagcaugcaucagaaucaccuggaaugccuauuaaacgacugcuaguuccacucccaggguuucugauuuuaaaagucugcauuucuaagaaguacccagguuaugcagaugcugcagguccaaggaccacacuuugacuacuacugaauuagugcucgguuagugaaaaucagugauuugcauuaucaagaauaaacccaucacuacuuaaaccagcagcaauacguacaguuauaauuuuuaugagaaguuguauguccugcaacacagcugcuuugucuaaguggcuuugugcuuuauuauccuaacaaugggugaaaaagguaguaagaauuuguagaaaaaacugaguagaaaugaugacaaaaaaacucuugagcaaagucuagauguaguaaaauacugaauuuguuuggugagguuuagguucauauagcuaugcuucauggauccucaacccccaggccacagucuaguacccagcugcacagaaggaggagaaugugaaugugaaugucaucuguauuuaaaguaaaccgccccccaccccaucacucaaauuacagccugagcucugccuccagucagaucagcagcggcauuagacucucauaggagcgagaacccuauugugaacugugcaugugagggaucuagguugcgcacucuuaugagaaucuaaugccugaugaucugccauugucucccaucacccccagaugggacugacuaguugcaagacaaaaagcucagggcucacacugauucuacacuauggugaguuauauaauuauuucauuauauauuacaauguaauaauaauagaaauaaagugcacaauaaauguaaugcacuugaaucauccugaaaccauccucuugaccccaguccauggaaaaauugucuuccacaaaaccagucccuggugccaaagguuggggaccacuucccuaagagcuauuuuuaagucuugaaauucuuguggaaaaauauaauucacugcaagcacaaauuguuuucuuucauucaaucauuuucaaaacacuauuguuuuuaaaacauaaacuuucuuagaaacgcaacuaucaguucacagaaggaagaacugcauuuuguuuugccuucaacuauuuauauugaucagcaauuuauaaauuuaacucauucuuaacggugcuaaccacaguuaaaauucuucuauccagauaacauagacugugaaacagaaaagcaaagcauggacaguuuaauaaauuccagguguguuuccagaaaaacaaaauuuauaauguuaaauucuucauuagcccauuuaaaaauauauacauauuuagcauacauauacuuuguacacuacauuucacauguaauugaugauaaucacuuaccuacuguuggaguauuggcagcacucaaugaagcagaugaugagauagaagaagaacuuucugcccgggcuaauggugcagcaggaggugggcugguguuggaaguuacaggugggcugaauggccugggcuuaaaaacaaaaaguuauuuaucaaaaugcuaaaacaauaccucucuuguuagagaagauuuuuaaguaugagguaaauuuaacauaccaaaccaaauuuacugugugaguuucuuguaacuuaguaucagagaugccauauaucauaucauuuuuaagaacauacuaaagccugaaaagauuauuuugaaauaaugcuguaaaaaaggucuuugugcauaaaaauuuuucuguauuuaaaaaaguauguuuaagacagauucucagaaguuaaauuaguuuaaacaguauaaacguucuucccaaacugcuucccaaaaggguuauucacuuuaccugacuauaaauauaagaaaauuauuucucuacacccuugccagaaacaaauggaugagucacagaagaagaaaaagggauuaaaaauuuuuucuagcuaauuuagaaaauaauaaaaccuucacuuuuaugaauggguugauguaauuuggggagguuuuaguauuaucugagcuuucacuaagccuuugccuuauuuucuugcaaauauuuuccuccuuaaauauugcuuguccuuuacacuuuugguguuuacaaaucuguucacauuuuccucaguaauuccuuguaaugcuuccucacucagaaaacucacuccauacaaagguuugagcgacucaauucuguugucuucccaauuuucuaauuaaacauaaaacaaauauaaaaaauauaacuccaauucauuuaucuuuuacuuuggugaacagauucuuuuccuuccaaauuccuaacuguaccaauaauucaguagcaacacuuccugagguguuuugcuuucuuaaaaaauaggcguauuugucuucauuuaaaaaaaaacaaaaaccuuuuccugcuuauaaaaguauuaggcaaauauauauuuauuuagugucuacuaugugucugacccuggauuagguacuagauacaaagcugugaacaagaaagauaacuguccucaguuauuugaggaacaugaaaaaaaggcaaaaacaaaacccuacuugcauucauacacuagucaauucuucauugcaugaauauaaacuuagagauacacauuuuaauaaaacugucauuuuacugcaaaaaguguuuuacaauuuguaacccccuacccauuuaacuauuuuuuccagaguacagcuuuuugaugacucauuaugauggacaauagguugaaaaaacucagcaggaugcuaaaaaugcagcuguguauauacgcagaccaagguggugcaggacauuggggugaacagauacugaucaacagcuagucugaaacuuacaagcuuggaaaaagucuugagaucaacuacugugggacauuucuccuauggcaacauaaccucuaggccaacauaaugugacugccuuuuuaauuuuuuuuaggaaaaggcaaaaacagcucuuuucucaagugguuuucucuaauuuuagaauuaugcuaucuacuacaguggccaauagcacgugaaaugugacuaguccaaauugagaugugcuacaacauacagagcaaauuuugaagacacagcauacacacaaaaggaauguaaaaucucauuaauuuucauauugaauguguuaaaauaauauuuuuauauagcagauaaaauauauuacaaugaauuccauuguuuuucuauguggcuacuagaaaacuuuaaauuauauguugcuuauauuauauuucuauuggacggcauugcuuuaaaacaauguuucugaaacauuagcaggcaucagaaucgcauggagggcuuguuaauaauacacaguugcuuggccccuccccugaauuuccaauuugccuggggugaagccagagaaacuauuucuaccaaauucccuggugaugcuaaugcuacugaucugguacugcacguugggugccccugcucuagaacaaugagugguucuuucaguggguagggaggaugugguuauagacuccuuugagcaucuggugaaagcuaugagcucucuccagaaaaaugcacauaugagcaugcaaaaaaaaaaaaaaaaaaagaaaaggcacuccaauguacagcuggagaaaauuuaaaucaacauacucucucuggugggugauacagaaauaaucaucaagagucuuaaaaauguacauacaguuuaguucauaaauugcacuuuuaaaauuuuuuauuaaaaaagaaugcuaagaaaccauaaggacagucauuaagacauuguuuauaauaacaaaaacauggaacuaaaugucaaauaaauuucugaaaacauuuagaaauuuaauucugacaacgguguagaagacagagcacucauauugaaauacucuguagccacuuaaaauagugcucccugaagcucagagggugguuucuagaaggcucucaaggauggggagaggguaguguauggugauauggggaugaugugaaggauucaacuaugagucccacuuuauuuuaauauauuaauacuuacaauuuaaaguuauuuggcaaaagauucuaucacuuuaaagaagcuugaagacuaugaaauaagaauaauucauucagcaacauggauagaacuggaggccauuauccugagugaaauaacucagaaacagaaagucaaauaccucauguucucacuuauaagugggagcuaaacaaagguuacacauggacauauacaguggaauaacagagagugaagacuacaaaaggugggaggaugggaaaaggguaaggguagaaaaauuaccuguuggguacaauauucacuacucaguuaauggguacaccaaaagcccagauucugccgguaugcaauauauacauguaagaaaucugcacuuguauccccuaauucuauaaauaaaauuauaaucaaagaauaauucaugauauagaaagauauuugcaaguagaaaacaaauuagaaauauguaaaguaugacuuuuuauuuaaaaauaugccuauacaauuaauaauuuuugagcaacuauuugcauucaacaauauucuguuuuacauguauuaacucauuuaagucucacaaccuaauaucauuacacauauuuuauccaugaggcaacuaaacucugauuaaauaacuguuuaauguugcucagcuaauacguggcuaauaagcuuguacuuuuaacuauauuuuacugccucuggauaaacacuuaugcauuccaaaaaauguuaacagugguuaucuuuggguggugaaauacagaggaaauuuauaauuuuccuucucugcuuucucuguuuuccaaauuuuauaacacgaucauuuacuguuuuuacaaucaggaaaaaaaaaucaauuuauuagaauguacucaaaguucuagucauaacgauuuaaaaaagagaaugaaguauuuuaaaauguaguaauuucuauauuacuuaaauaauaaccuucuccuuggcagcuuguaccuagucuuuuauuuuacuuccacuaagucuguucauucggaaaagaaagauaucaccauuucaauacuuggugccgaagcuuuucaauauauucacugaagauuucauaacuguguaccacccaacaggcaucaugcaaaguacugaggauaugagacugacgaaggaauagcccaguaaagguaacacacacaaaaaaaguacauacaaggugauauaugaacuaacaaaaauauaagcaaaguaucuggguauaaggaagauaagugaaggaaugaucaaagaggguuuugccuagguggugauguuuagcuaggucuuaaagaaagaagucaauuugugacauagaaaacugaggggcauuugagauacagcacaggaagaagacauggacauguaaaagaccaugauguguuuaaggaacccugaaaaguuucaaguggcuggaaccuagguugaaaaggggagaaagauggacaguuagucugguaauguagguuguugaggcagcuuuauaaagacucuuguacauucagcuaaaacagucaaccacacagacugagaaaccacuggaaauguguaucaagggaaaaaagauuaaacuggacuuagaaauuuaauucugguaauuaaacuggcaauuaguguagaagaugaagcaaaacaaaccagaucaaaggcaaauagacugggagagccucacugcauagagucuauagauuuucucuaucugaugacuuuuaaaaaccaaugcuuuucccacccaugcauguacuuuuauaagucaacuggaugauguggacuccaguuuccuuauguguaaaauuuuaaaugcugagcuagaugccuuccauaauccuccuugcaguauacuuuuaaggucuaagaacaagccaccauuuauuuccuuaacauuugacuuuaaguagaauuauaugaaaaccgcuucuuuauugugagacaauggauacugaaugguauuuuuauaaugugccaacuuucucaggaaaucucuuuccuccuggacaaugucgugucucacagguaugaucacugugguaacaaggaagaguaaaggaagcacuagcugggaaaauuuuucuauacugugaggacauggguagaaaacuucaagcaauuaacuguaaaagggcauauagaaaaauagcauuugcaucuuaaaucaaaacaguuaaauaauuuuuaaaaaaccugaguacauacuauuucauuaaucccacugaguuugccugaaguaagcuuuggucuggaagcaggccucggaggugggacaauggugccuacagaaagaggaguugugggccuggcugguugagggggaaaagagaauuugaagaaaaucauuaguauguagcaauccuuacauaaagacauucuauuauaaagaaacuuuugguaaucaaagcucauuuuucaggaggcucuuuuuuuagauguaauuauagauguugaaauauugggaaucuaucaaauaugcuuuauuuugaagugaccaguaauauuccugaaaaaaaguuaaccuuucaauaacugacacauauaaauuuuauuccuguuucauuaucuauacauauaaaaauuaaaucugauacauuagcugaugagaacaaaucaauuuaaggccaaaggucauuuguuuauugccaauacaucuauuuuacagauaguaauucgagaccaagccuuugaagcuguaccuccagaauaauauuguaaacucuaaauaaaauacuuaccuuaauuaaaauuguuaaauuugccuuuuaaguugaaccacauuguaacauuuugggggguacauuauuugagauaaucagauauucuauuaguuuacuaaaaaaaauuccccaaaucauuacaauuaacuuugguaaguguucaaaauaauaucuuaacuuguuccuaaguccuauauaaauuuaguguugaguuuuucaaugccauuugcuaauuuuacaaaucagaaauaucaguauucuuaaucucaucacaauguaaauuacuggauaaaugucauguauacaucaucaaaagucacaaauguauuagcauaaucaaagaaggaguaaaaaaaauggaaguaaauagguuuaaacccucuuuaaaaucauguuuaauaaucauuaauaaauuaacuuaaaugauuuucaaagcccuuuggcucacacuaaaauacaggcuauaauucagagacugaaaaauauaaugggugggaagaaacauauucagcauguuuucaaaguuuagagauguacaaaauuaaaaauauauaagugggccuaaguauacacacggggaaauaaacugcaaagcuaaaggccuuuaaucaucaauggaggaaucaaggaggcaugaaaggaaggugcauagagguaguaggaagagaccuaaagaaaaagguagucacacggauugaaaguuguacaugcaugggacguagggaaucacuuagaaagcauaccauaauaagagauaaaagaugcaaacgcuguucagguugcuuaaggaaaacaaaaaagcuaguaaaucaagcuuagauucugaggccacugucuuuuuccagucaguaccaguucuuucaugcugcacucacacuugaagcuguacccuggaagaaaugugcaccaaaaucugaagcccauaacacuucccuguguauuacauaucuacuuuaaagauauguucaucaucaaugaaacuagcacuagccuauguuauuucaaacuugugagagaguuuacacagcagaggcauuuauuacugaucaaguggucuguccaaauggcauuuagauugacucaaaccaagccugguagaaguauuaaguucaguucaaaauuugcuuuucgagaaaagcuaguaacaauacuuauuaacaccacuguuuauaaaugaaucuauauuauaucugcauaggucaauuaggcacugcuucuagaagcuucugaaggagauaacugcaauuguuuacuuucuucaguguccuguguuuuauuuuuugcugguggugggguggagaucagugcuacaaauuucuauuagaagcaguguuucaagaaauauaaauugaccugugaaguauaaaaaaacauaggcgauaagggcuacucuauaucugcccucagacauuaacuaaagcaaauagacaaagcaugcuugucauaccauucuuuaucugaacaaaaguggaaacuaaucuagaaucuagaagcaauaaugaugauguagaagaaauagcagcagcacuguuagcugcuucugcagguacauuuucaaaacaucuaauauuaggcaaaggucacugugauccucagagaugcagcugucggaagaaaucccauccaaagcauuaggaaaccuaaaaguauuuucagcuuuacaaugcaaucucuggaaugccuucugagcaacacuggagcuauuaauuguaacaaguucaucaguaaagaaaauccacugacuuuguagccaugaagcaaaaggaacuuuaucugugcucucgaguggugcuguuacagcagaauaaaguagagauuugggggacaagucuggugauggacuuucuagacucagaaucugacuggguuucaaguaaauuuucaauuaucacacacccaggcaaaucagugagaaaggaacugaaguuccuacucugcucuacaaguucagaugaagaagaagaaaauaaaaaacuacaagcaaaaggaaaauucuagaauuaaacauaaauccauauaaccaaauaguuaccuuguuuuaauuauuugaaacuagaaaauuuaauaacaauacacggaagaagagcauaaguucaaacuauauuaacugaagaaguauguacauuagaaacuuaaaaugcauaugaaaaacugaagguccaaaauuauacaaagucagaguuauuccuguuuucccagaggagcaaagguaacuauuuauagucaguacaagaucuaaaaagauucgacaagguggcaaagcaacaaugcuguguaugugugguacucaacaaaguucaucauuguccagugauaaaacugcccccaggaaguacaucggacuacaucaggguucgaguuaauauuuaaaaacagcccaauauuuuucaaaaaaucauuuuaagcgguuuuuuuuuuuuuugugagcacaagaguucaauuaauucauaggcagagaaaguaaucuacauuggcacuuaacaaaggggagguaggcguaagauauuuauguuaaauuuuuaaaaauacacauaucgauguuuauauauauucauaucugacauaaacaugaaugcuuauuuauagucuacaugguauaagaugcaacugaaacuacuuuucagccaagcccuaaucaacauuuuaaaacauguaacaacacugggauucuuaacuaucaguuauuaacugauugauugaaauuauuuuuuagccugcuuuaagaugaggucagugaugaauuaagauuaugaaagacacacaggagagcacugaaugaucucacaaccuggaccuugcuaaaauguuaaaauggguaccuggguagaggauguuaagaugggagagaagugcauugcaaagaaugggggacaaaguuuaagacugguuguaacuagcgaguaccaagaaaacaauaaaaauaagugaaauaaaaauuuaagauaaaaugccuauuucguaacuucacuuagggccaguucuguaaaacaggagaaucgcaauuaugaauuaauuaguuugaucaauuauauucuguucaagugaagacuuaauaguaacuacuauauaacaagauaacuaucucuuuugagcaucauuaacuuuuuuuuugaaaggcaaaauuuauaacauuacuuuucauacuauauaggaagauuuaaaaaugcauacugaagugaauuuuaaaaccagcaagaaguuaauaaauauuguaucauuuccuaauggccaaacaucaaugaccacuaaaugaaaacgaaccauuuuuuaccugaagugauggugauaugagccaaacacucuuuagacagggagcaaaaggaagaaagaguacuuuuauaaaaugaaagagacuguacuagagaaaauaucaagaaacaaugagcagaauuauaaagaaauuucuauauaaauaaaaccucugugauaccaauuugaaaacuuuuauuaaagacuuuaauaauucauaaggggauauuaacaaaauucgaaaauacugcugagaacuccucauucuaaauacaaaaugccauucugacauuuuuacuaaacaaaagagagaucuggcaacaacaucagauuuuccuguacaauuacuuucuucauauaauauauauaugguuaauuuuauaauacuaaauaguaacaaaugcucaaugagaaaggcuauaaagccacuucagauuauguucaacuaucuauugacuguuucuugcuguuuuacaaguauuaaguacagauuaccuucccuucaaaaggucaaauagcguuuaguguuuaggguuaagguuucuuauaauccacuuauaguaucuuuuaaaaauauuuuguugcuaaacggucuaauuuuaaaaaccaauauuuaauuuuuaauaguaagauauuucaacauggcuuuuuuguuguugcuguuaaucugccaaagugugacagauagaacaauggcuuuagaauaaguaagagccagguuugaaaccugucuucaucauuuacuagcuauauaaucuuggagaaguuacuuauuaucucugagcuuuacuuuuuucaucuauaaaacagggacaauaaaaacaacuucaugcugcuguuaauguggugaaauuaaauagaauguguggcacuccuaacaaaguuaccuagcaugaacuagacagauuuaaguucuucccgcaugauuccagcgcuuccuuaaccccaaauacuggauggcaauucugaagucccagagaagaggguagaagaucaacuaaaauugauuuuauuuucuuguuuugaacaagcagugguuuuauuaaacauacauuuuuggugccugcuuuuugacuaaugaaaagagaaacuucauauauuauugccaaaacaacuaaaaaacauuuaucaacuucuuuuguaaacugcuugggaaguguuaaagccuuucuagaaagcaguuuggcaauaaguaucauggacaucaucuuguaagccauaaauuuuaaauugauaaauuacuacaagcauauuaugagacauaugcacaaaauuuguuauuucuauggauguucauaauacuagaaaauuagaugcaacuuaaacuuccaacaagaaagaacugguuacauugauauauauuuuguauuugaauuaucuauaaacacuaagaauuauuauuuggauaaugauaugaaaugccuagaaauaacaugccaauuuaaaaaaccacuuaguauuuuaccaauuuuuauuguuuaagucauagaguaucuaagagaacaaaaccagaauaaaaucacuuuuauuuggcaauacagaggacaaauuuuuagaaauuuugaucauuaaguacaaugcacaaaaagugaaugagaaaaagcaacuaaaguauucuuuauuuaaaaaaauacauauauacauauauauauuuaccugaugaugaugaaguuagugaagaugaagaagaugaaucaagagaugguccaaauagggggucccaagcaaguaaaucacugguuccuuuucuaccauaauauuuuuaaaagcaaaaauuuuaacgagaauauuuuauuaguauaaaauuucuagucacuuauuuuuauuucauagaauucuaacagcucaauauacauaauuaaaaaguuagggccaggcaccauggcucacaccuguaaucccaacacuucuggaggcucaggcaggaggaucacuugagacuaggaguucaagaucaagccuaggcaacauagcaagacccaauauacacaaaaaaauuuuuuuaaauuagccuggcuugguggugcaugccuguaguccuagcuauccaggaggcuaaggaagaucacuugagcccaggaguucugugcugcagugagcuaugauugcaccacuguacuccagccuggguaacagagcaagaccccguccguaaaaaaaauaauuuuuuuuaauuuaaaaguuggauacucuaucaguaguauauguguagaaauuaauuaacagauuuaacagccaauauuuguuagaagcguaaccuaagauaacaugugaaguuagcagaggagaauggggaagauuaauucccauucaucaugccuuguuagauucaaccaccuugggggcuaucauaaugggaauaauaauuucagcuuuacaaauaaaaaagagcagcacacgucuaaaugaacugcccaaagacauacagcuacuugauucuaaaacaggcucacaucugcugguucacacauagcacccaauccugaaaagaaaauuuaagugguauaaaauuggguuaaaauuuuauaaggccauacuuauuuucaaagaugaagaaaaaggguaaagugauuuuuuuaagcccuuaaguacagaaagguggcuuacauauuuuaaugcaucaaacugccauuauuuuaaaaaauuuuaggaaaucuuacacacacaaaaaaacaggcccucuauaaugaaagugcuguaauuacauaagaguacauauccagcaucucaacaugcaccuacaugaaagcacacuauaccucguaugauaaagccuagcauugcaacuguaugacuccuaaaaacaguuuuaaaacacucaacaacuuaucuuuaaaaaaaugauacauccaauaaauaccaccacuaugcucaauuaguaccucaaaaguaucaaauaauuguaaacuaccuauuuaacuaagccuacuuuuacuuguauuuuacauuaacucuggccaggcuugauggcucaugccuguaaucacaguacuuugagaggcucaggagucugaguccaggaguucgagaccagccugggaaauauagcaagacccaguaucuaccaaaaaaaaaaaauuuugaaaaaaauuagcugggagacaggggcgggaggaucauuugagccugggacguugaggcugcagagagccaugaucacgccacugcacuccagccugagagacagaguaagacccugucucaaaacagacaagcaaaaaaccauuaacucaaagagaguauucuuaacugauagacacagaaguaaaaagagacccaugaaacauuggcuuaacauuuuuuuuuuuaagaagagcuggcaacaugccuucuagccucucucucccuuuccaacuugacacacuucuuuuuuugaagcuuacgaaguauauuauuuuauaacgucacagucaaaacugaaggaagaaaugagaaaauucccaugagaauaaccagcugaaauacagauauguaugaauuuaggguuucaucauuuauuuagaaguagugaggcuaccaaggccaacugugguuaaauagauuuuuuuuauuguaaaaggacauauuaccaagcgagaaauaauuuuaaacuucuaaaaacuccaacauugcauuugacagcucagaaaacaggaugauuaacagaacuuuacuggaauuaaaacuauagagcuaauaaaacucuagaaaaaaagacaaaaggauacuuaaaauguaaguguguggaagaagggaugagaagguggagcacagaagauuuucagggcagcaaaaauacucuguaugauacuauaaugacgaauacauguccuuacacauuuguccaacaccaagaaugaacccuaauguaaacuguggacuuuaggugauuaugaugugucaaugcagguucacugauucuaacaaauguaccacucuggugagagaauuugacugugagagagacugggcauaugaaggggcagggagcauaaagggaaaucucugugcuuuccauucaauuuugccauaaaucaaacacugcucuaaaaaauaaagucuauuuuuuaacaaaauuaaacauggaaacuuacucauuggguggagcagauggcuuugauuuuguuaacuccucaucuaauuaaaaaauuaaaauaugaaaacuucauaaucugagaaauaaaauauuuuaaugaaaaacagaaacucuauacacauaucucaacacuauaacaauuaaaaauuuuggaauugauaauguaaauacaaacaauauuuuaacaaguuuucuauuguguacauuaaaauaacugaaauuacaaaacccugguuccuucuaauaucuuuaguaagaaaugacuuaagucaauuaaacuaugauauucauuaaaauugcuguuuagaaaagagaaacuauggguugcaacuuuaaaaauuagaaaaauguuuaaauacauaaauucuaguuaagaauuuuaacugaugaaucaugaaugcauuuuucaaguucuaagaauauuauuagugauuauuguauugacaaaaaguaguuauuaacucuugaggaugucauauuuugaaaaauuaagaaucuuacagcaaccuggagcaagucucuuuauaagauaguuuguuuugcuaccuuuuggauuuguaaugugccucauuucacaagcaagugguaaacaggggaauagcaucauuaaugaaaaacucauguuggugcauaagcaauuuuugcugcaccuucauguuuucuuugcaucaccaagcaauaccugaugaaugcaaaguacaucaauaugaguaacuuccacaaacuauggaggaguaucacaguacaugauaaccauucacucuacauucuucacuuggcucaguuugguugguuguuuugccucaguguuuauugugcuauucuucaauauuucugcauuuugcucucaucuccacaacucagcacccugcauuuauccucauuuuccucacacccccuaucauuaagcuacaaucaacauuucuuuaaagauaaaauccuuacuuuuauuuugguauuuauuauucauuuacuaggucucuuaaacucuguuagaauuuuuaauaaaacugauguuaaaguuucuguuaagucuucuguuaacaaaauuacauagcuuuugagugggcugcuucaacuguuuuucccacaacccuuguuauuuuuaaugcaugauucugcaaaagguauuagcaccuuagaaaaguuuuuaguauaauuuuuaguauaauuaaauuauaauagaauuuguaauugugacacaacuuaaaaauagguaaaauucaauauuacucaucuuauaaacgcuuucugguuaauaagacagagaaugccagugaaaccguuuaacauucugaaucagaaguuacuuuuuggcuuuggugauuucugaaaaauguuguagccauguauugaaguuuaaagcaugucucucagcucuacaggaaauaauauagauacgcuguuuucuauuuaaaauaauuauccuucuagccacgcaguagggcucaugaugagaaaagaucauuuauuucuacagcuaaagguaaaagacuaacaaauugccuuauaaauuuuaauagacauaaaauaaacaauucaaaugucaaacuuacuagacaaauuccgauucaucuguaccuaaaacagagaugcaaaauagguaccauaaaacaaaugaauuugauaauuaaauauuugguaaaauguuaauacugggaaccuaauuuuauguuguuuuuaguauaucugcucaauuguaaaguguauuuacauaaaagauauagagaaaaaacaguaguuuuuguuuuacagcaaaaaauaauacauguaguuuuaacaccuaauguuuuuaaaauauuaaagcaacaucuacaacaaaacacuaaaacuugcuaaucuaaaaauuuaauacaaauauuuugaaagucaaucuuccaaaauuacaaugauuuuaaaagucaaugggcaaaaauauaaaaucuuguacuuacuggacugugucucuaguaguacauggaagaaaaagaaaauuagguuagaauucugaauacuguauuuuugugcuguaauaauuuaucauucccuauucaaucauaucuaaacuauauacaccuuaaaacacauacacugucaggugggaaaaaguuaagcaaaugaggcagcaaaauauauucagauauaaucuuuucuuauccaauauuaacuauaaaauuguucugauuauuauuuucauaguaugaaauuaauacauguucauuguuuuuuaaaaacaaacugaaaagagaagaguacaaaagagaaaauuuaaaacuauucacaaucucacuacccauauauuccucuaggcuuuuguuuuauauauuuaacauacauauuuuauauuaguuaugcucuuacauaacacacauuuuuaaugguuuacaaccucauacuucguauauauucaccaccuuuuuuuuuuuuuuuugagacgaagucucgcucugucacccaggcuggagugcaguggugcaaucucggcucacuucaaccuccgccucaugguuuucaagcaauucuccugccucagccuccugaguagcuaggaccaaaggcgcaugccaccacgaccggcuaauuuuuuguauuuuuucaagagacgggguuucacuguguuagccaggauggucuccaucuccugaccuugugauccacccgccucggccucccaaagugcugggauuacaggcgugagccaccaugcccggcccuauauucaccaacuuuuaagcaacucuguacuucaacauuaaucuuaacguuaaauaguaaugguacaauaaaaccucauuucagaaauauuuuugguaggaagaaaauaguucugaaacuaaauucugaaguacaugacugggagaaaaccaccuuuuuuuccaaacaaauacauguaacuacauaaaauauguaauuagacaacaauaugaaacggugagaaccuuuauucuucauuaucaagaagaacagacuuaaugucaaucaugaugaucacauauagauauacuuaacuuauccuaagaauugcuuuuuucacauaguguaacauuuuuaaguuuaaaauugacaucaaugaggaaaaaauuuacugggauaauguuuuauuucucccucaaauccuauuaaauacgguauuuuagaauugaggaauuaacuauuaccacuaagaacucuuaucugugccuuuccuuguaugaaaaguaugggaaaauaaauguuacagugacagacuaaaaaaaaugcaaauauauaauuuaaucuuuaaauucauuuuuauaaaauucccuccuacauaaggcucacaaaacauagaagaaacacuucaaaauuagaugaggcaaaaauuaauacugccaauucaaagaauucugccagagacacacagcacuguuuaugaaaugcaacaaauggcagaaauaguaaauuuuugacauuuucacuuucuacuuucaaaagcaaaauuaagccaaauucacaaguuuauuucccuguauaaaaauuauaaacuaaguauuuccucagucaacaugcuuaacaauugcuaaguaauguuugaccagacacagguagguaagaaaaauaaagacuuuuauauaaagaguacaaacguguuuguacuuacagauauugcuggggagaguguuauauucccuauagauacuuuuaauucauccaaagaagccauugugugaugugaguuauuuggaugcauaggcuuaauuucuauccgauacuucuuugguucuucaucuucggagucagaaucacuagaugaguagaaaugguucucuuugguaugugaguuucaguuaaagaauuguuuuuaaauuaccuuagacguauaaccaguuuuucacacauuuauuuuaaaaaaggaaugaaaccuuuaagaguuacacagacuuugggccgggugcgacggcucacgccuguaaucccaggacuuugggaggcuaaggcagguggaucacgaggucaggagaucaagaccauccuggcuaacacggugaaacuuugucucuacuaaaaauacaaaaaauuagcucggcaugguggcaugcaccuguggucccagacaaucgggaggcugaggcaugagaaucacuuucacccaggaguaggaggcugcagugagccgagaucgcaccacugcacuccagccugcgugacagagugagacuucaucucaaaaaaaccaaagagaaaaacagaccuuaacagaaauaagacuacuaacuuuuauuaauaaaaauaugucaaggccagucggguuagcucacaccuguaaucccagcacuuugggaggccaacgcaggugguucacuugaggucaggaguucuucaccagccuggcuggccaacauaaugaaacccugucucuacuaaaaauacaaaaauuagccaggcauggugcgcaugccuguaauccaagcuacuugggggacugaggcagaagaaucgcugaaacccgggaggcagaggcugcagugagcugagauugugccacugcacuccugcccgggcaagagagcgagacucugucucaaaaaaaacccaaaaaaaacaaaaaacaacaacaacaaaaaacaugucaaaugacaaacaaggaaccauauuuuauaauuaauaaaaaauuggaagaggcuuuaauacaugauuuucuuauaacugccuacuuauaugccaacauaauccuuaagaauacuagaugaugaaaggauaucauucugauuuguuucugguuuaauacuguagccuucuucaucuacaucaggaauguucuaagggaaaaagaaaaaaaaauuauaaugacaacuccaauguacaaaauuauuagagauuaucaaaguagccucagguauuacuuaggaaccaaaccgcuucucagauaucaacagguuaaugaaaugaugaacaccgaagaaaaauuacaccuuuuuaguuaauuagcuucaaaucacacuccaugcucuggcuaccugaaagaggaaagaccugcaaaaugaaacaggagaaacacaacucauaauuucagggcaagaaaucacugagguggggaccaauucagauugcucaaaaucuacaguuucuguuauaaaugaggaagaauaaguuaguuuaaaaaguacaugugauuugaaagcuauuaucaagcuaaauauucuuauugcuauaagcuguauggaaauauaagaucuagcaccuccuuaugcaguuuaagucugggugaacuaguaaaacuaucuaagacaaaccaucaaugucugccaacaugccauaaagagugacaaccagacaccaugugugucaugagagaggcagcccugacaaaauaaaacaagaccaaaaaaaacuugaaccuggaucugaucaagccucuagauccaaaugccaauuuaaauaauauaaagaaguaaaacauaauacaguauggcaauauaaucggcaaaauccagacuaaaggaaacuauaaaacaaaccacuuagucuugccaauaaaaacacagaaagcgggcccggugcaguggcucacgccuguaguuccagcacuuuuggaggcugaagcggguggaucaugaggucaagagaucaagaucauccuggccaaaauggugaaacuccaucucuacuaaaaauacaaaaauuagcugggcaugguggugcaugcuuguaaucccaguuacucuggaggcugaggcuggagaauugcuugaacccaggaggcagagguugcagucagccgagaucacgccacugcacuccagccuggcaaaagagcgagcucugucaaaauaaauaaauaaauaaauaaauaaauaaauaaauaaauaaauagcagaaagcuaaacagagagggagggagggaaggggaaccuguagaucaagagagacuuaagacauaucaacaaauucaaacaaagcauaauaaaauggacaucaaagaugauaaauacugaaugguuauuucaaaauacuaaggaguaauaaauuauuucuagaugugaugauauugugauuauguuuuaaagauauauaugauguaucgcuucuuggccuuuuggcuaagaucaaguguaaagauauauauaauguaaauucagaugaaauuauaauauucuagaauuugggcagaggaaauggaugggcaggauuggcuggggcaagcugcuggggcugacugaugagaccccaaaaugagagaccaugaugguauuuauauguauauguauauguauguauauaucuauguguauauauauguauauguguguauacacacagacacacacacacacaauuuguuuagaauucuucaaaauaaaaagauaaaaauaaucuagcugggaguauuaaaaacagcagaaguugccuaaauauuauaacucagaaauuaguuuuaaugcauuuuaacagcuucaagaagggguuuucuggucacaucauaaaauucccauaaguugaaagaacacugcaaacaaggagaaauaacauacacaaagucaaagaaagauaaacaaacauucaguucagguguucagaaaaagguuuuuuucaaguuaaagaaaacugggcaugccuaaaagcagaagaggagccaauaaauacuacagauaucacaaauaugugagauaaaaugagaacaagguacucuaagagucaagaaaaaacaggauaagacaaaaaggccccucccuguuccucaaggacuaggaaaaaauaaaaggaagaaaacagguauuuggguaggaaugccagcagcuuuguggaccauaaauuuuucauucaaauccucaaaguaaagaaauaaaagguuaaggcuacguguaucuuggggugugguguggugaagcaaaaggacugagaguguaaauauaaaccauaagcaaaaaacaaacaaaaugagaaauaaaagacuaccaagaaaauuaaaacuacauuaagauagcaaauucaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaaagauagcaaauucauaagcuugaaaauauacucuguuagugaagcugcaggggaaaggcauauucauacuuuguggguauuaauacaauaauuggcacaaccccuacagagaaaaacucagcaauguguaacaaaacuacauauauauucacucuuuuacccaggaaucccauuucuagaaauuuaccgugaagacacagcuccaacuauuuaaaaauauauaugcacaagguuauucaucgaagauuauuuauaaccuguaauuauuagaaauuaccuaaauguccaagcacagcugaauaaacuaugguacauacacaaaauggguaaagccauuccuccauaucugcagguucgguuucaguauuugcauguauucaaccaaccgcagauugaaaauauuuuuauuuuauuuauuuaguuuuuugagauggagacucacucugucacccaggcuggagugcaguggcccaaucucaauuuacugcaaccuccaccuccugcagugauucuccuuccucagccucccuaacagcugggauuacaggcgccuaccaccacacccagaaaauuuuuguauuuuuaauagacacagggugucccuauauuggccaggcuggucucgaacuccuggccucaguugaucugcucaccucggccccccaaaguguugggauuacaggcaugacccacugugcccggcaaaaauauuuaaaaaaaauaaaaaauaagcugauugugguagcucaugacuguaaccccaguucuucaggaggcugagggcaggaagauugcuugagcccaggaguucgagaccagcaguagagcuggcaauauagucauaucucaucucuacaaaaaauuaaaacaucagcugagcauggaggcaugcaccugcagcccagcuacuagggagcugaggugggaggaucgcuuaagccugggagguagagguugcagugagcccagauggugccagugcacuccagccuaggcaacagagcaagacucugucucgaaauaaauaaauaaauaaaaaauaaaaauacacaaaacaugaaucuuuaaaaaacacaguaaaacaacuauuuacaauauccauuuacauuguauuagguauuauaaguagucuagagaugacuuaaaguaugacuuaaaggauauguguggguuauauauaaacacuaugacaguuuauguaagggacuugagcauucagugauucugguauccucaggggguucuagaaccaauccugcaaggacacugaggaacgauuauacuauguagcuguuaaaaaaaaaaaaaaggaaaaaaguuucuaugaacuaauauggagugauugccaggaaauacugcuaauuuuuaaaaagccaaguaguaaagaacauauauaguauuauaacuuuuaaguaagaagggcaaauaagaacacaaacauacaucugcuuaucuuuguuuaaaaaaaaaaacuacagaaaggauaauuagaacacaauaaaguugguuaccuacaaggaagggcaaugggguagaaggacacaggaaagacgaacacuucucugaauguguuuuugugguuagauaauggaauauuugaaauuuugggacaacauauacuuaaguauuuagagacaaagggccagaauauauuuaauuugugcucaaauggaucagaaaaaauauuauacacauauaaacacaugcacaaacagagagagaaugcaaaugugacaaaaauaaagggcauacaaguguucuucguauuauuucauucuugcaauuuuguaaguuagaaaugauuuccaaauuucaaaaaaauuuuaauggaaagaaaaggcugccaaggaauugcagcaaaaauccuuuuacugguaagguauucuguucuucuaaucacuuucuaaagcucagcaagaaagauaugaagaacugugaaggcaggcacaacacaagguuagggagaacugagggcagcauuuaugugacuaucacuuccagacuaaauaaacagucuaauguagcuagcagugaguuaacagauggaauuaaaaacuagaaauaaaaaaccuaauguagggugaagagcagauuccacggauaaaaagaugacaaaggccauauuuuuaacacugaagguagagcccuuucuuucuacugcuugcuaauaugcaaauaucacuuuaaaauacuuuaaaaauaaggaaacuuugcuaauugugaaucuuuuagaaaucagaaugaaagguuuuuuucaaaauacuuuguccccauuccaaguacccuaaaaacacaccagguauuuagucucccagagguucuaucucaaauuuaacaauggacuacuuuaaauuuguuuagaauacaccauuuguuuagagaauacacuaaaugcacaauguaauaauuuaauaauaccaagcuguuuucuauauggcugaguaagcagcuuuuggaccaaccuccuguagacuacaacgauaaauucugaucaaaacaucaacaggccaggcacgguggcucaggccuauaaucccagcauuuugggggggucaaacaggaggaucacuugaggccgagaguucaagaccaaccugcucaauauagcaagaccuugucucuacucaaaaauaaaaaaauuagcuggguaugguggcacaugccuguaguccuagcuacuuggaaggcucaggcaggaaggaucacuugagccaaggaguucaaggcugugguaagcuaggauugugcuaccgcacuccagccugggccacagaucaagaaccuagcucuauuaaaaacaaaacaaaaaaaccaccauaaacaaccagcuggagguaauggaaaaugaccuagagcaccaacuaaaaucacucuacgaagugauucacugaaaaacucuauaaagucacaauguaauucuaaaaaaggauucaaauaaccuacagaaaggcaagaaaaaagcaaaaugaaacaaaaacagaggaacaaacaaaacaagaaauggcaaucuuaaaaucugacaauaucauuacauauaaaugguccaaauauaucaauuaaaaggcagagauuggcagaauggauuuuuaaaaacauaaucaaacuaucugcugucuauaagaaacucacuucaaauauaacaauauaguuagguugaaagaaaaaggauggaaacaauuauacuaggcaaacaugaauaauaacaaaggggaaaagaggcugucuuuauguuagauaaaguagauuucauaaagaacauuaucagggucagagaggaacauuauguccacacaaaaaccuguacacaauuguucauaguaacuuuauuucuaauagccaaaaauugaaaaacaaccaaaauguccuacaaugggugagugguuaaacaaacuuuaguacauccaaaacagggacuacuacucagcaauaaaaaauaaacuauucauauguaccacaaccuggauacaucuccaaagaacugugcugaguggaaaaaagccaaucucaaaagcauacauauuguaugauuucacuuacagaacaaccuugaauugacaaaauuauaggaaugaagaaaagguuagugguugccagaaguuaaggaaggcguaaggaaaaguggcuguaaaagggcaaccaacaugagagauuguugugcuaaugaaaauguccuauuuugauugaauuagugucaauauuucaguugugauauuacaugacaguuuuguaaaauguuagugucaggaagaagggguaacaaguacacaguacuguuacauacaccaucuuugcaaccuucuaugcaucuuuauuucaaaauaaaaaguuuuucuuaaaagcagugauucucaguguacuaucuuuuuacugcuagaacuaugcacagaaaccugauauuaauaaaaacguacccauuaccuguguucaucuuuacccauucaauccaugauuucuauauuagggcccauacagcuggagugaagcccuaggucaaaagcaguaugaacaagaauagaacaggcaacuucacccaucaaucuuaaaggcaguuguuuacucuggcuaaaguagugguggcaauuuaaaaaauauauaccagaauggagcucaagagucaaugaaauguuucuuaauuucuguuuggaauguggacauaggccaaaaccaaaaaaaaagaaagaaaaagaaaaagaaaaaagaaaaaaagagcaauuacacuuccuuggccaacuuucaaaagaugcaguugcuaaaaauaauuuuuuaaauuacauagaccuuuaaagaaaggaauaagaaaugaacaauaauuucccuaccaugauagccuauugauguuuuaaaaaauaauuaguaagaggaagccaugaauaggccguaaguuauuauuuauaggcuacaaauaaaagaaaauaacaagccuggauaacauagugagacauugccucuacuaaaaaugaaaaaacauagccaggcaugguggcauaugccuguguucccagcuacucaggaggcuggaaugggaggaauggcugagccugggaggucgaggcugaagugagcuaugaucguugccacugcacuccagccugggugacuguauucgucuguucucacaucgcuaucaagaacuaucugagacuggguaauuuauaaagaaaagaaguuuaaucgguucacaguucuacaggcuguacaggaagcauggcuagggaggccucaggaaacuuacaaucauggcggaaggcaaagaggaaggaagcauaucuuacauggccagaguaagaggaagagagugaagggggagaugcuacacacuuucaaacaacaagugagaacucacuuacuaucacgagaacagcgagggggagaucuauccccugacccaauugccucccaccaaucccuuccuccaacacuggggauuacaauuugacaacagauuugggcagagacacaaauccaagucacaucagccacagagcaagaccccaucucaaaauaaaauaaguaaaaacaagucuccuuucucuacugaucacuguaauucuuggccccaaagguauccacaaguaaaguaccuuguaacucauucuucuaaaauaaauauaauacauauauccacauauuuaucuuauuuuuaaaacagcaaucacuuaaaauaucauacuugcuuuuauuaaguucuuuccauaucagcagacacagaucaacuuaauccuuuauaacaucuauuaccccaccaauuuauuuaaccaguucccauuuugauggaugcuuugauguuuccaguuuuuugcuaauauaaacaauguugaaauaaauaucuauuuaucacuuucuauauaugcaugaaucuugaucaagugugucugcauguguacaaacauauauacuuuauauauguguguauauguauacacacacauauacacacuaauacaauguguguguguguguguauguguguguguaaaguuuuguuacuauaacuguaacaguaaauuccuagcagggagauggcauggucaaaaaugaacucacauuucuuuuuuggggcaauacugccaaacuauccacaagacagacaguaucaauuuacauuccuaccaacaguaugagcauaucaaaaccuuuguuggccaggaacagugguucacaccuguaaucccagcacucugggagacugaagcaggaaaauggcuugaagccaggaggucaagaccagccugggcaacacaaccccaacucuaccaaaaaaaaaagguuuaagaaaucagcugggcauggugacaugugccuguagucccagcuacaugggaggcugaggcaagaugauugcuugagcccaggaguucaugguuacagugagcuaugaucacacaacggcacucaagccugagcaacagagugagaccuuguuuccaaauuaaaaaacaaaaaauuaaauugaaaagaaauuugccaauaugauuagacacuagacuaaauucauucuaauuuccaccagaagaacaccacuauuuugagcaauauuuauuaugguuaucacuuuuauuucuuuuuaugaaaauugaccauuuuuauccuaugcccuuuuccuacuaggcacccacuuauuuucuguauugauuugcauauaaacuuuauaaaugaaagcaauuaaccccugucacgucuugcaaagaugcucugccagucucugauaauucaaauccuuuuauaacguauuuuuucuaguuuuauauauuuuucauuucuacacagucaaauucaucaaucacuucuuauucaguauuagaauucuguauucuuuuguauucuggauaaguacuaaguaaaguucaaaauuggauaauauugaucauuauaaaauaguaucaguuacugaauuaaaaauguuuuauuuaaaaggaauauauguaaacuaaaacaugaaguauuaaaguuguauuuaauuuuacaucaucaauuuaaugcuacaaauaauucagaaauaaaaugcauaaaaauaaugcagaaauaaaaugaguacuaaaguuaaugccaaacacaucugcugcuuuucauuaauuaguuaaccaaggguaucaaacagaguaaccaagugguaagguaaacauuguaacuccaaaaauacacugaugguuuuaaccccguaacucauuauaagucuauuucuuauuuuucauauaaauuuguuaacaaaucauaauuguauuuuaaggccaaaauauaaaacaaaauacuaauuuuaucuuaguuaaguaacauaaaacacaguguuucacaaaauauuuuuaguuauuuuguuacacuaugaugcuguaaaagaucaaaauguuuugggaucaaaggaaacaauaguuacgcagguaagaacaauaagcaaaggacagagauuguuugaaaccccuauacuuaucaacaugaacgguaucuaaugaacaguuuugaaaaauaugucugucuacacauuacuuaacagcauuugguaaaucuacucucucacuguaaccaaagggagcuccauuugaugucuucuuuaauuacacauaaagaaauacauuuaaucaagaaauauaagcaacccuucuuuaaaauaaaacaaaaagcacagaaaaguacugaccaugguucuuguugcuguuauuucuaaaaugacaagcucuuaaaugaacucaaaugcacgcacaauguuguauuuuaauagagcuaagaauaaauuaguaagaacaccacauuuuaaaauaaaguauacagauuugauuucuggcauguuucccaagaaaaaaacagaaugauauggcaccacuccaauuuuaaaaguaaaauguccacucuucaaaggugguuagaaauacuuucuauuuaauaggaaagcaucuggcaauguaaauccaaaaaugcaucuguaaaauaauuuuaauagugaauuuacaauaugaugguauuuuucuuugaaagacugguaacaacucaacucaaauguguuagguuuguccuaaugaaaauaacuaauuuaaauuguuuauaucaaaguuaaaucuacuuaccaaugaaucugcaucaggacauucccuauuaaaacaaaauaucagaaauacucaauaauuagaauugucugcuaauuaugcuuguuuaaaguauuuacuuugguacuuaaauauagcuuuuauuuaaacucuacaaaaaauauucagagaaaucaaaccaugaagauuaaaacauaccaaauuauuuuaaaauucaaaaaaggcauucuuauacccauaccaccugacaaaauaaaaaacaaacagcuuacaaguauuccuuuuuuucuaacagcuuacauuaugcuuugagagcuuauaaauauucaaaaaccuauuuugaaaaauaauucuuuuccaugaauauacucacacaucaagaaagcugucaguccuacaaggcuuucuaauggcuuuucauucaaguaaagcaaguuaaaaaaauguccuuaaagaagaaagcuugacuuuaaaaaaaagucaguauuaaguagcaaguagucugaaaacccaaaacuacuggaaaaaauacaauuuuuaaacacuucaguuucaucugaaguacuuuccauaacuuaguagauacaaaaguuaaagcuaguuuuuuccaaauauacugaguagacuuccaguuggauaacuuucuuauguaauguaauauguaguugagaacugaaauucuaucauuuaacugauaaacaaguauugaauuugcauauacacuagugaaaaguauuauuuaaaauguaaaacuauguuuauguuuauaaagaagaccuaaauauguacaacuaaggacagugaggucauuaaaaaugagguuagaagaauuuccauguaugcacucuaaaauaaauucacaaacaaaaauuaagagcgcagacuuaaaagguuuuuggaccucugacuugugacaguuaaugcacacaaagcaggcugagcaucccuaauccaaaaaucugaaauccaaagugcuccaaaaucugagaguuuuugaacacuaacaggaugcucaaacaaaauguucauuggaacauucuggcuuugggauuuucgguuuaggaauacucaacuggauguauucugcaaauauuucaaaauccaaaaaaaucugaaauccaaaacacuucuggucucaagcauuucaaaggauacgcaaugugugucaaaaucuuauacaaacagauaaacgccauuuauccaaauacuaagcaaacaccagaagaaucuacaaaauugaagaauuuucuuaaaggaaaauaggauaaaacagacugaaaaaauuaaaaaggaggaagaugacuacauugcucuuaauccaaaacgaaguaccaaagagacaggguaaaugcaaaccccaggugacuuucuuucuucuucuuuuuuuuuuuuucuuuuuuucucugacacagagucuuacucugucacccaggcuagauggaguucaguggcaucgucucggcucacugcaacuucggccuuccagguucaagcaauucuccagccucagccucucaaguagccgggauuacagguguguaccaccacaccuggcuaauuuuuguauuuuuaguagagauaggguuucacaauguuggccaggcuggucuugaacuccugaccucaaguaauccacccuccucggccucccaaaaugcuggguuuacaggcaugagccaccgggccuggccccccaggugacuuucuauccacuuaaaagucauuuaaaauugcacauuuugaaauacagcuuccuuacugguagaugagaaacauuauauuuuucuaaacuuaugcauaaucugaagaaauguuccagaaaaggcauaauaauaauaacccaauccuucuagagaaucaaauuaaucaagauguuagaacauuucuacuuucuucuuuuuuuaaaaaagaugcaguuugaacauaaaaggaaguguuaaaguuccaaagaguuuauucucuggcuuuaggccaaaacacuccagucauugggguaaaguacuuaucuguuugcccucacagugggcuguaugacaccugcagaugaagcuccaggaagaggaagcucugaaaagggccugucucccacaauuacuagcaucucaaaagccuucaggcuaugaagaggcaugccaagagccucuggcauuucaggcaaagugaauucuaacauuuuuuccugccaagaaguuugaaagaaggugaugaugguacagugguuuaagcaguggcuuucugcucuacuauugccauugguuaaaaaacaaaaacaaaaaaccacccuaaguggcuuaauaucauauugggaaauuauugauaaggaaaacuguuuuaaaaaccugguuaaaaaauacuauaagcucccuacaugaacaguaaugaaaccuauacauuauaaaaauaauuuaaggccaugauucuuuacaauauagccacuaacagaugaacuagauauauuuuaaacauuuacuuacuaaucaauugaucagauuucaauauguauugcuaauauuauaaaauagauuagguuucacccccuuaaaaauauacccuucauaaaugcucaagaaagacauuugcagaagauuugauaacuauagauauagaugacuuugcaauuggucuugauuuguuaaccaaauacuacuugggagaggggaagagagucauuuaaaaugaaagaaauucuaggaaacucaaauagaaauauaacuagguagaaagcaagaauacccaaagcacaaacuguucucuuauguuaaaaauaugagugcccaucaaauauuaaaucucaugagaauuccuuugauuaugcuagggaagcuggguuuuuaaacuaauuuucagucaauguuggugggucaacaaauuuuuuuguuguuuugacucaagacuuuugaucggugucucuucaaucuaaauggacugaguaaucauugaaagaaagauucuuuuaauucuaguuugucucugaauaaucacggcucaaagauucuuaaccccagguauacauuaggaaucaaaggggcugcuuaaaacaaaaaagagcaaaaccuauguugagguuucaugcuuagagaaucugauuuaauugaucugaggugggaccuggcauagguguauuuauuuuaauuucccagguaguucuaauguguagccaaaguaaaaaacaaacaaacaaacaaaaacuuuaguuagcuaaucuaaacucaauuucuuacauguuuauuacauauucuuuguauauuaauuuuuuauuuuuaaaagaagguaaaucaggccgggcgcguggcucaggccuguaaucccagcacuuugggaagcugaggcgggugguucaccugaggucaggaguucgcgaccagccuggccaauauggugaaacccugucucuacuaaaaauacaaaaaauuagccagaugugguggugggcgccguaauuccagcuacuugggaggcugagguaggaggagaaucgcuugaaccugggagguggagaaugcaguaagccaagaucgcgccauugcauuccaaccugggcaacaacagugaaacuccaucucaaaaaaaaaaaaagaagguaaaucagacuuauaaguggaccaaauauuccaucuaaaaaugaugaccuaguauaaaugguaaaauguuagggcuuuucucuccccuauuuaacauuuuccaucaauguauguauagguaucaccaugugccuguacacucagaauugucuagaaggauuuucaucaaauaguugaccagagauuuucucuuaggcauuaagacuuugaugaauuuuuaguuuucuuugcacuuuuaauuuuuuaaaauaugcauuuaucauuuuacaaaaauaaggauauuucaaaacuuuccauuucuagacauuaaagcuuuugucuauaaugucuuaacauuuucaaauaauuaauaauacuuugaucuaaaaccagaggaauuggcaaauguauuuauuaauauuuagaaaggcuuguuuuucacaccuuacacauauacuuuugaguuauuuccaaaauacuuuuuucuuuccaaauucaaaagucuuauucuuaaucacuuauaaaaacaaaaaggauuuugacgauauuuaaaauacuuacacagauucugcaucuuuuuccuuuuuaaugauuccuggcaaagcaaaggucuuucuuuuccuugguuuuauaccuuuaaaauaaauauauauuguuacagaaacauaaacauuccugauaaacauauuaaacuuauggauacaucuugcauccucacacauaauuugcucauaacugcugaugcuaaauguggaugacagaaauaaaguuagcaaccacucaacccuauugguuagacuuuucuuauguuaauaaaacauagucuauuguuuaucaaaagaucauagaacauuuacuuuauagauaaaauuuucuuuucuuuuccuaagccucccuuaagucaccuuacacauaauaagcauauggagauaucuuaaaacuucaaagaaaguacauuauucauuauacuaaauuuuguuauaaacgucaaauaauguuauaaaggucaaaucauguuugcuuuuuagagggccacaaaauauaauuuuauuguuuuagauaaaaagaugauacagcagacccauuagaaguauaauauggggccaggugcagugaugcaugccuauaaucccagcacuuuggaaggccaaagcggacagaucacuugaacucagaaguucaagaccagccuaggcaacauggugaaacccugucucuacaaaaaaauacaaaagauuagcugggugugguggugcgcgccugugguccuagcuacucgggaggcuggggugagaggauugcuugaguccaggagauggaggcugcagugagcugugaucacaccacugcacuccacccugagugacagagugagacccuaccucaaaaauuaaaaagaaaaaaacagaaacagaaaaaaacaaaaaaacaaaaaagaaguaaguuuacaauauggcauucuuguguccauaauguugucccuaauacaaacaaugcuauaaauggauucuaccauaaccgaggaguaaaaauuaucuuugauuuuccuaauaaggcauccucuucuuucaugacaaauuauuuuuaaaggccagucaugcuauuaacuuuugauagaauucagcacuuaaggccuggugugguggaucucgccuauaaucccagcacuuuggaaggccgacgugggcggaucaccuaaggucaggaguuugagaccagccuggccaacauggugaaaccccguuucuacuaaaaacacacaaaaaauuagccgggcguaguggcgcacaccuguaaucccggcuacuugggaggcuaagggaggagaaucauccgaaccagaaggcggaggaugcagugagccaagaucacgccagugcacuccagccugggugacagagcaagaccccgucucaaaaaaaagaauucagcacuuaaaacuuagguguuuacucuuugagaauugagcaguagagacugggugugguggcucacgccuguaauccuagcacuuuggaggcuaagguggauggaucacuugagcucaggaguucaagaccagccuagccaacauggugaaacccuuucucuaaaaaaaauacaaaaguuagcugggcaugauggcauauaccuguagucccagcuaauuuuggggcugaggugcaaggaucgcuuggaucugggaggucgaggcugcagugagcagagaucguaccacuguauuccagccugggaaacaaagugagacccugucucccaaaaaauaaaaacagaagagagcaguagagaccuuagguuuaagcuagccccucaucuuacagaugaagaaauucaagaaggguuuuuguuguuguuuuugagacagggucucacucugucgcccaggcuggagugcagugguacaaucacagcucaccacagacuccuccucccaggcuccagcaauccuucuaccucagccuucccaguagcugggacuacaggugcacaccaccacaccugcuaauuuuaaaaguuuuuuuguagagauggggucucaacauguuucccaggcuggucucgaacuccuggacucaaguaauccuccugccucagccucccaaagugcugagauuacaagcaugagccacugugcccagccaaaugaugguaauauuaacauaaauuaaugaaauguuacccacuguacaauuagcacuacacauuacagagaugaguuucauauuccugaauauggcuuaaacauggauuaacaaggcuuaaacauggaacaaggcuuaaacauggaugucaaugaagaaaacuauuucaauguauauuuaaaaacaaaugcauguuauacucaaucuuuaaaaauauauaaucuaacacacuaauauuauuuugggaaaaucuguuauuuauuaagcagcaaguagcaucugcaggccuucaaacuaauuucagauuuuuacagcauuccauuccauagguaugcugacaccuagggauagcagucccuccuuauuuguucaaugaacagaagauacuagcuagcugccaugugcauuaacauauuauaacuaaucaacuuaccuucaacugcacuagcagugucacauucuucaaauucaaugaggccuggaaaaaaagaaauugaaaaacuucuaguagaaaaaaacuauuagguaaauuuuaaaacuuuuuuuuuacauuuuaaauuuuuuauucuacuuuuaauugacaacgcaucuuuuuaauuguucugaaaugguucuaguuguuaccuaauaauuaaaauaucagcaauaaauuuuaaaaaucaaauaauucuaacagugaaaaauaacaagacuagcccauuaugaucacaauaauuuacugaaaaccaauuacauaugaugccacaaaacuagagacacaagaauaugcaguuucugcuuucaagaagcuggcaguacuguuaaugagaggaaacaagcaugguaaaggugguugcugaauccucggugguguucaugggaagaacagggcuaccaagauaguaaauacuacuagaacauaagcuugggaccucaucuguccuguucaucacuguaucuucaauacuuaaaaaaugccagguaaauaauaaguuggguaaauaaguaaauauuuauugaaugaauaaaugaacuaauuacagacuaguuaaguggugaccuugggauuauaauccagaucucucuaacuguauagcaggucaaggaaugugaacuacagcuuacaggaaauaggaagaguuuucauguaagaucauacacauccacccacaaagagaucuucaaggacaauuaauuuagcauugcuaugagagauagauuguagaagaggaugaugauaaaguggaaaucauuagaaaacaauuaaaauagcccugaaaugacugacugcucagacuagccuuaauugccauaaaauauggcauacuucauauaugugaaauaucaaauuauuuggcagugugagaaaguagcaaaacaugaauuacucuccuaaugaaauaucccagaagcuaaauaugagacuaaaaaauuaucucccacuaagcugucauuuaguacuuuuuauauauaaauucaugaaagucuagcuuuuuuugugaaauaauuuuuaauuuauuaaugguaacugguauaacuugcuauaugaagaaauuuuaaaauagagcuugaaacagagaguagaugauagaggauuuuguuacugguucuucugagaugugaagcuuaacuauguacaaauucaugaucagcauuauuauugaucauuccauuaaaaaagaaagccacugauugauuaacaagaaagauuucucuacaaauagggggaucuaaaaauauugucuuaaugucccucucccucccccuaaaccuaagauuuauuucugugugguucuaguuuccauucaaauaaaauaaauuaacauuuacuaauaagcagaauaaaacagucauagaagugaguugauaaacaagguccuaaucaauuauuaguauguuccuuacuaauacauucuucuaaauaugaacaaggacuaaaaaaaauguuuaucacuucuauccaaaaaagccuuaaagagucagaaaaugacccaauuaaaaauuuaaggacuuuauucaaacccauucugcaaaucuggaagcugagaaaucauuuaauaaaaggguacugagcuuguucuuagaaucccuuagaggccuaucguaacaauuuacaaugagaugaaggcaggcugaaaaaucaauaaggguaaagaaauugagaugugcaaauuagcaacuuuucacuuaguauaaaaauuaugaauaacaaaucucuaccuaaauuaccaacagcuuauuauauauuauuggcuuuuccaaguacuaauaaagcuugagaaaauauaaucgucuguugagacaagaaaggguuuaccaaaaaaaggcaaucaggcaugugguuagucaaaaauucuccuacagcuacacauccacauaauuucuacccauuaacuauuuacagaaucucuaaugcucaggccacacgcuuacucuagagaguagaaaaaaguaaguaccauaaaaacaaaacaccaaugccaaauugccuuguuuacaaauacuaaauauauauuaucuagaaggacuuuuacaucaucaucuuagcaaauaugguacauacagaaaaaaagauuuguaaaaucuuuggaugacuucauacaugugaaaacaguaaagacaucucuuaacuccauaaaaucagucccuuuaaacaaaauucuccuuuuuguucucacaaaacucuuuuccuauaguaaacauaucuugauuucucuuauguuuucuaaacauccucuuaaaauccauuugaaauagaaaaauguccaaaaaaaacacauuuugaaagaugccaaaucacuucaaaucaaaaaauauauauuaaaaauuuuaaauugaguaccauccacacaaacuuuucuauuaaagauagaaauaaugauuucuggcauaauaaaacuaaauacuaccuuuuuaaaaaaaccauuaaaucaugcaugaacaagauuuucuuuuacaaauggcauaugcuccacaugccgcuucacauggcaaggcuuugcgugccuggcucagugccaguugacaacucagcuggauaucaaugcacauucugacccccccuguagcaugucacuucugaacuguuucacaaguggaaaguuuauucagcaucuccuucaaaugcaguccacugcccaucauucugcuauuuaaucauaagacaaguuauuuuuuuugacaguacuaaagccagagugagagucuuaaugaauaguuugcuacaacuggaauuuuaacuguuuuagacucaauuaauucuuuugucaaaauaaauaacugcucuuagcacuuaaauuuuauguugggucacaagggcaauuuaguuuguauaaaagcaaauaaaaccauuuuggcucugucuccugaugcucuuuuacacauuauuuuaaaacaccacuaugaguucaauuaaacucauagaacagaagaacagcucuaagaggucaaugauucaaagcaaaacaauucuuaaauaugaugcuuuaaucaucagguaggaauaaauaaaugcuauaagaaaagccaucaaccuaaagaauccauucaaaccuaauuuggauuaaaacuuugaaaagauguuacaagaagaaaagcaacuuacugaacgguaaucuuugaucaccacaaauguuuuguggacugaggaaaaguacaaaauaugugaaauauuuaauuaauaaucccuguugcuucggaaucaauccuaaaucucaggccaucaacaggacaaguuuuuaacauuaguuaaaaacugcccucaaaacucaaauagaaagucugggcuauucaaaucaagcauauuucugcuucuaaucagagcuaaacacaaacacucucagacauacacuaaaaguuuaauaaaaggaaugaugauaaugaaggggugugugcaugugugcaugagcaaggaaagaguugugacucauaacaauggaaaucaauuacuacauuuucaagcuugcuccugggccuguggaaugcaacacagucacauucccagaugccugggaugauaggccaggcaagcuaacacaaaaaagagaaucacacuccaguuuguggugauaugcacaggguauagaggcucaaauucuaauuuggauacucuuuuugaacuagaugcucuuuuugaaccuagguuguaucauuuauaaaagguaaaugauaacaaauauagcauuugcuuucucucucucuccacauagccuuauacaauuuuuuucuuuugcuaaaccauuugaaaguugcagacaucaaugacacuucacuucaggaguauguguuuuaaaaaaggacuugcugaaucaauuuccucaauucagcaguuucaaaccucaugagagacuccuggcgcaaugcuucuaaacuauauuauguaugagaaucaccuggagaacuuguuaaaccacagacuacugggcuccacucccacaguguucuauucagaaggucuaggguggagcucaaauauuugcauuuuuaacaaauucccaggugaugccacugguccuggaaucacauuuugagaaauacagcccuaguagacucuguggccacugguagauauuuaauuagucuagacagugcuucuccaauuauacugugcauacaaagcccagagcaucuugggaucuuauuaaaauacggauucugauucaguaggacugggauaggauuugagauucuccauuuauaacaagcauucauguagugugaugcuauagguucucaacaauggcugcuaguuacaaucagcugaggaguuuuaaaauauagugguauccacccuggaccaaugaaaucaauuucuuggcugggcaugguggcucaugccuguaaucccagcacugugaaaggccgaggcaggcagaucaccugaggucaggaguccaacgccagccuggccaacauggugaaaacccaucucuacuaaaaauacaaaaauuagcugggcaugguggaggaccccuguaaucccagcuacuugggaggcugaggcaggacaaucacuugaacccaggaggcggagguugcagugagccaagaucaugucacuacacuccagcuugggugacagggcaagacucugucucaaaaaaaaaaaaaacaaaaagaaagaaagaaaagaaaucaauuucuguacauaaaaaaagaaaaaugcaaagaaaaaaauguccaaaaauaauucuuguauguaccugauacgguuuggaugucuguacccuccaaaucgcauguggaaaugcgauucccacgugggagguggggccuaaugggagaugacuggaucaugcaggaggaucuuucaugaauggcuuagcaucauccccuugguaauaaguguguucucgcuaaguuauuucacacaagaucugguuguuuaagagugucugggaccucccccaucugucucauguucccacuauugccaugugacaugguggcucucuguugccuuccacuaugauuuuaaguuuccuaaggucucaccagaagcacaugccagcaccaugcuuccuauaaagccuguagaaccaugcgccaaguuaaauaucuuuucuuuauaaaugaccuagccucagauuauuucuuuuuagcaacacuagaauggacgaauacaguacccaaggcuugaaaacuaugagaaaaauuuagaaacuauagucuuaaaucaaagaaauagguuuuuaaccacagauuucagucacugugaaacauuccaaaauuuuaucuaguucuccacagaaucuuaguacugaaauauaaucuccucuuacauacacauuuugacaguguccccauacucauaagguugagucauguuuucaucuuccaugauccugauaaagcccuuguuucuacuuucaauuauaguacuuaugucuauaagcauucuccauguuaguugcaaccauauccuuucaguuacucaugccaaaacccuuaaaaugauucuucccaacuccuuuuuaaacagauuuucugagguauaauuaacauaugauaaacuacaucuacuuaaauuguacaguuuaaugaauuuugacauuugugagucuacuaccacaagauaacauauauaauuaucaccucaugcuccuuuguaacccauuccacccuucccaaggcaaucacugaucugcuuucugucacuauaaauuaguguacauuuucuagaaaguuauauaaauagaaucauauaguaugggcugggcacgguggcuccaccuguaaucccagcacuuugggaggccgaggcggguggaucacgaggucaggaguucaagaccacccuggccuauggugaaacccugucuccacuaaaaauacaaaaacuaacugggcauaguggugcgugccuguaguucuagcugcuugggaggcugaagcaggagaaucacuugaaccugggagguggagguugcagugagccaagaucgcgccacugcacuccagccugggugacagagcgagacucuugucacaaaaaaaaaaaaaaaaaaaaagaaucauauaauauguauucuuauuuuggucuggcuucuuuuacucagcaaaauuacuuugagauucauccauguaauugcauguaucaguaguuuauuaauuuuuauuguugaguaguacuucacugcauggaaauacuacaauuuguuuauccguucaucuguuaauggacauuuggguuguuuacaguuuggagcuacuacaaauaaaacugccaugaacauucauaugcaagucuuugcacauauauuuccuuuucucuuggguaaaugccuagggguagaacaacuggaucauaugguaaguguacgcuuaaauuucuaagaagcugccaagguauuuuccagagugguugcaccauuuuauauuuucaccagcagucuuugugaguuucaguucuuccacaaccuugauagcauuugguauacucagucuuuuuuucuuuuucccagauggagucucgcccugucacccaggcuggagugcugugguacaaucucagcucacagcaaccucucugccuccugggcucaagccauacuccccucucagccucccaaguagcuaagacuacaggugcacaacaccacgccuaauuuuuguauuuuuuuguagauacagaguuucaucauguugcccaggcuggucucgacuuccugggcucaaggaauccacacaucuuggccuccuaaagugcugggauuacaggugugagccagcaugccuggcugguauagucagccuuuuaaauuuuuaucacucuauuaagugucuacugcuauuuuucuugugguuuuaaucuguauuucccuaauuacgaaugggguaucuuuucaugugcuuacuugacauucauaaauauauauauuuuuaggaaguguccaaaucuuuuggucaccuuuuguauuaacauguauacaaaauuuugaaauaaauuuuaaauucuuuacucauuuauuuuuaucuguauggauuaauggcuauuuauuuuauucuuuguguuaugaucuaauauauucauuacuuauuacuugcucaaguaauuccagcuuuggccacugggaacucuuuucagguuaucaccuguguccuucuaaacuacaaaacuucaacuaaaggaaauagaaaaauuuuuaaaaaucuuugugaccuuggauuagacaaacguuucuuguauuugacacaaaagcauaacacauaaaaaaccaaaauuugguaaacugcacuucaucaaaauuaacuuuugcucuucaaaaacaccggaaaaaaaaaaaaagaacaagccagacugggagaaaauagucacuauauguauauauauaaauggaaaccugcugaacuuuuaugaauuauaaauagcauaaaguaaaauuaccaaaaugacuguaaaauagaaaacauugaaaauauggauuuuacucucuuuuagcaacugaauuaccugagagugguuaggguuacaagggcaaugucaauggaauauaaaaagauauacaaaauuagaaaacaccaguuuauucaugaucccuucagaccacaggugccuuaauauucaaagcauccucuuacagugacucaaauuccagaggaaccagccauuacuacacuaaaaaaaaaaaaaaaaaaacaaacaaacaaaaaaaaaacaaugacaggccaggugccgugguucacaccuguaaucccagcacuuugggaggcugaggcagguggacugcuucaggccaagaguucgagaccagccuagccaacauggugaaacuaugucucuacuaaaaauacaaaaauuagccagguauggugaugcacgccuguaagcccagcugcuugggaggcugaggcaugagaauugcuugaacccgggagguggagguugcacugagccugagaucaugccacugcacuccagacugggcaacagaaugagacucugucucaaaaaaagcaaaacaaacaaaaaggcaaugacaaaaagugucaguacauacaauaaguaauauaacauuaucauaacgaguuagaaaaaaauuuguaaugcucucaguuugacuuaagaacugaaaacacaaacugacagguuguaucuuucaauagauaacugacuaaaaauaaaauuggugucauuuugcagcaucagagaaauagguuaacuuauguauacaauuuuuuuuuuuugagacggaaucuugcucuugucguccaggcuggagugcaaugaugcaaucucggcucauggcaaccuccgccucccagguucaagcaauucuccugccucagccucccaaguagcugggauuacaggcgcccaccaccacacccagcuaaguuuuguauuuuuaguagagacaggguuucaccacauuguccaggcuggucucgaaccccugaccucagguguuccaggugauccacccaccuuggccucccaaaguccugggauuacaggugugagccacugcacuuggccucuuuucuucuuaaauuacccuggauuauuccaacagucaugcaguggucucucuaccucgauccuugccuuuuucugcaggcguucucaauggaguaguuagaguucagucgccucggccuccgaaagugcugggauuacaggcgugagccaccacauccagcuauguauacaaauuuuuaaaagaauuggaucuuuuguuuucuuuuaaagaucucuaucccacagaacuaaagcuaguuuaggguggaacucauccgccagaggggcuccuuacaaaagaggagaaauaaaauguuaacagaaaucaauaguauaaaacaauugaagguuagaauagacuuuacaaaacaaaauccuuuaaguccauaaauuccacacaaucacaagcaaaauuuugucuauguuauuuuucuaggaagcacaaguuuuguuauugcagugagucacuagacucauuugcucaggugcccauaaacugaucaaaaacauacaaaagaggccaggcacaguggcucacaccuauaaucacagcacuuugggaggccaaggugggaggauuaccugaggucaggaguuugagauuaaccuggccaacauggugaaaucccaucucuacuaaaaauacaaaaauuagccaggcaggguggugggugccuguaaucccagcuauuagggaggaugaggcaagagaauugcuugaacccggcaggcggagguugcagugagccgagaucaugccacugcacuccagccugggcaacaagagcgaaacuccaucucaaaaaaaaaaaaaaaaaaaauuagcugggugugguggugggccccaucaaucccagcuacucgggaggcugaggcaguagaaucgcuugaacucgggaggcagagacugcagugagcugagauugugccauugcacuccagccugggcaacaagugugaaacucugucucaaaaaagaaaaaaacaaacaaacaaaaacauaugaaaaagcugcaauuagucacccauagcaacucaaccagggaaauaauauuuaucccuuccacuccaccccacacuaguuaguuuguucuaggacuguuuaaaaguccuaguucuaugacucuuuuugggguccugaaacagccaccuaauucuggguuuagugacucuacgaaagcccaugucaucaccguucuuggcuucccuauuaccuccuaccaucuagcuguaaguauuuucuacaugacuucguauaucuuaaggccaguaaaauuaaauuuauaaugaaacuacauuaguggcuacuuauucaugagaaauguaucauuuuugaaaacaauauuuauuaauaaauguagacuaucucauguaaaucucacaacagccccaugaggcaguuacuauuauuauccccacuuuacagaugagggcacugagguuuaaaagucucacugcuaggccgcgggcgguggcucacaccuguaaucccagcacuuugggaggccgaggugggcggaucaugaggucaggauuucgagaccaaccuggcuaauauggugaaaccccgucucuacuaaaaauacaaaaauuagccaggugugguggugggcaccuguaaucccagcuacucgggaggcugaggcaggagaauagcuugaaccgaggaggcagagguucagugagccaagaccaugccacugcacuccagccugggcgacggagcgagacuccgacuccaaaaaaaauaaaacauaaaaaaaaaaaagucucacugcuaguaaagagcaggucacaaaccacugcacuacaccacagacaagaaaauaaacaugagccaggcacaguggcucacaccuguaaucccagcacuucaggaggcugagacagaaggauugcuucaguccaggaguucaagaccagccugaacaacauaguaagauucugucuccacuaaaaauuuuuaaaaaucagugggguguacuggcauaugccuguggucccagcuacuugggaagcucagguggcaagaucgcuugagccugggagguugaagcuacagugagcuaugauugcaucacugcauucuagccuaggugacagagcaagaccaugucucaaaaaaaaaaggaaaagaaaagaaaaaagaaacaugaucuaaauguccagaauucaaaaggaaucaagcagugagcuuaaagguaauuccuaauauacaguuauuaccuaaccaacagaaaggaauuuauaauaacuguauauuuguugaguucuucauagagaauaaaugaguagguugacaaguaggacauuaugaugaauaaggguucagcaauccccauauguugaguuagcaaaauuucuaagaacugacaaaacuuucauucaccugcaagucuauauuaaacgaaauuaguggcauauauuugauaaguuccaacauauuucuguguguuaaauaaauguguuuggacuacauuacuuuuuuuuuuuuuugagauggaguuucgcucuuguugccuaggcuggagugcaauggcgcaaucugagcucgcugcaaccucugccucccggguucaagcaauucuccugccucagccuaccaaguagcugggauuacagguacacaucaccacucccagcuaauuuuuauauuuaguagagauggaguuucacuauguuggucaggcuggucuugaacuccugaccucagguaauacaccugccucagccucccaaagugcugggauuacaggcgugagccacuaugcccagccuuggacuacauuaauuuuaaggcccccuuaugcaauaaaacuccaugauuauuagacaaaccgaauuauguaacuuuuaucuucuaguuuuaucuaauuauaaaguaaauuccugccucuuaaacuguuauuucuaauuauuuaaacauuaauaacaugauuaaauccuacaccugaaauacauauacaaccuauuguaguucuaaaacguuauauuuugggguuugguaucuuuguacugugauucuacaauguacuacaguaguaauuuuugucuguucaaaagauauuuccauuaucccuuucagaauacaaauccugcuccuccaugaucugggcaugugaccuaugcugaccaauuauaauauccuacuacccuaaacacagagauuuauucaaagauaagcaugugacaaaagcagaaccuuuccugaaauuaauaugcugacacuacaaaaaaaaaauaaguucuacuaggguucuaaacagaauggauauaggcuuggacuguugaugucuuccuugccagcuaugaggaaaaagucuacaguaggaacuuaauaaacugaagccaaguaaagacaagcaaaaaugaaagaaaagagugaaccaaaguccugaugaaauccauguggaccuugaaucuauuccagccuuccagguuaaaauagccaaugcauggaauuuuugcuuaagcuuguuuauauggcuuucugacauucgcaaacaaaaagucucuauugaacuaagcuggagaugacagguuucaacaugaguaccaacacucaauauuggcagugacugccuacagcacugagaugagagagacugagaucuccuccggggacgaaugcaaugaucuagcaacgguaucugccaugaauaaggcagcacaugccacauacuugucagccuuuggcugagcagugucuuaggaaaugacacuggcauauaaaagcaaaaagcaguaaaaagagcccaggaagccaaagcagagugggaaaaauugcaucagggaaaagaaaaaaagucacaaaaaaauggcaaaucaaaauaaaauuggcuugauucagaacacauuuuaauguuccaauuacucucuaguguaauacuuuaagaaaaacacugauccacuucaagcucauucucuguauucuuucuuuuugcuuaaauauacucuggaucauuugugacccagggaaaaaagguuaucguucaucaguuuagguucacauuuaaggucaagucccccugguuuaaaggcauucucaaaauuaaaauuuaugucaacauaucuacacuuaguucuagucuaauuuuuccaaagcaugugacuugauuugugauccaggaucaaaaaucccagaacugaaucccauuucugccauguacuagcuuagacaaaucucucaacauuaccucugaacauuucccucaucuguaaaaugagaauaauaguacauacuucaaaaaguugcugaaaaucaaagugugccuacaaagugguuggcaugguacauggcacacaguaagagcucacuaaacauuaaccauaauuauuuagcauucacuuaaaaaauuuucuaauagccacuccauuccaaccuucuuaacacccuaaucuugccauuaaaugcccauuuguucauucauuuaacaaaaauauauacugcuuacaaauagagaaaauagaugaaucaaauacagaacuuuuucacaaguacaaacuauuaagauuuaaugguagacagcaacaaggcaagaaagaaauauauaaguucucuggcacuuuugauggagaaagauaucauuaaagauaauaaccgggcucuuuaaagaguucauucauucaacacaugaugaaugaaugugguaaagaugugguguaggaaaguaguggaauacagcauuuucuagaguaaggauuaaggacaacuaaaguacuaaaggaaaaaaggaagcauguaugugaaacagcaagcaguucagguuggccucagugaagguacuugaauaggaguaaaagaaaguuaagacugcccucucccuucuugaccccuauccuuucucacccucccuccuucccuccugucgccaucacuucuggcaccgcugcacccauaggagcuccccaguggugauggguucucagcccuccauguuacugugggaugaagagcuugaggagauaaagaagaucaguuuuucccacagucaaaucacuugcucuacagccgguucaccagccuggacaaaggagagauggcauucucagccaugaagauuuccugaggauuccagaacuugucaucaacccacugggggaccgaaucaucaaugucuucuuuccagagggagaggaccagguaaacuuccauggauucaugugaacuuuggcucauuuccaccccauugaggauaaugaaaagagcaaagaugugaauggacccgaaccacucaacagccgaagcaacaaacugcaguuugcuuuucgacuauaugauuucgauaaagaugauaagcucucccguggugagcugauacaggugcuacacuuaauggucagaguaaauaucucagaugagcagcucggcagcaucgcagacaggaccauucaagaggcugaucaggauggggacagugccauaucucucacagaauuuguuaagguuuuggagaagguggauguagaacagaaaaugagcauccaauuucuucacuaaaggacagagaccaaacuguuccuugcggucuaguauuuaauaacuggaacuugaaaguccuccuucuaccaaccccaccuccaacccaucauuccccuucucccaaaguacuacugcuguugcacgacaaccccaaauauguucugucaacacaaaccugccuuugaugcauaaacagggcauuacagaaugguacacccagucuauuucuguucaguauccagucacuaguucuucauuuauaaguaucuuuuuccccauucugcugcugaaugcauauccauacagucugagaaagugagagacggaaucaugccaagaacaagccagcaaagcucuuucaccagauguagacuguagcccuacugccuucccucuagcaaguaugccaccaugcuucuucauccuuuucauauguccuuugcuuccuacuucugugucauccaacauacuguuugcuuagucuggcagucuuucugcuuuucaguaagccucaaaaucuaaucuguucuacuuggcacugcuaugcccuauguauuccugacuugacaggauaguucaggggucuggcaguuuuuauuuaccuucauuauuaaaugggccucugggauguugccucuccaggagcuuuuugguaaccaacacuucucugagaaguaugacacuauccucugcauucuacucugucaucaaagggcugcuggguggagauacucaucuugaaagguggccuuggugagagguguggagacaagucuucuggguugcuugcccacaucacucuaccucuggccucugauucucaacuuuuaccuacauggcuccucguuagugcaguguugacuguucaaaaaauagcaauaugccuauggguuuguuuaguuuggggacaccguuaccaccagaaugacugcucuggcaauaugccuggggacuuuuucauggcuuuuuaucaaggcagcuggacacccuauaaagccucacgcauucacaccuuugcagcaugguuuaugacuuaguguuacgugcacuggaauguuuuucacuucacauuuccaaguagaaagauuagcguuaacuuaucccaguccaaaacauuuaaagauuguuuccuccguaucuugaaguuuugcacaaaauucuuuuuuauuuuuuuaagacggagucuuacucugucacccaggcuggagugcaauggcgcaaucuuggcucacugcaaccuccgccucuggguucaagcaauucucccgccucagccucccaaguagcugggauuacagaugugcaccaccaaaccuggcuaauuuuuguauuuucaguagaggguuucaccauguuggccagguuggucuugaacuccugaccucaggugauccuccugccucagcgucccaaagugcugggauuacaggugugaaccaccaugcucagucacaaaauucuuuaugaauuuuacacuuggcaaauguuaaugauggaagccauagucagcuccuaauacauguccaaagcauugacuauuguaucauuagcugccugguuacacuagcuuccuacuuccuuguauagaccacugcuaaucccuuaaaaaugaggucuggcacuaguagcacaaccuaagguggcauuacaggucuucgaacaagccacagcaacuuuucugccaaagucagcuuaguuuagacuucagugaaucaagcuauugccauccuaauguaugucccuaugagucuauuuauccaaacaucugcccuuggcugacuuucucugauucacugcuugcgugcuuguuuccuugcuuuggaaaacuauugaagauguguacauaauuauuuaggaaggggauugcuaaaaaaaauaccacugcaaagugauggaaaaggguagagaacagggaaguagcugggcuggauggcucaaauauaaaugaaugagaaauucuucaugaaguaucagucagacuuugugaucaagugaaaacggaagaaugucugacacugaucuauagagagguacuucagaggcuccuugauuugcauaucuaaaguuccuaagguuauagcuuuccccucuuuuggcuguauagcaaacuguuuuaauccacgguugugccuuauuguuccauuaaaauauaucaauaaacacuugugguugaaacaaaaaaaaaaaaaaagaagaaaguuaagacuaaaaucuggucagcucgagauccuuaaaggcucugaaaccaaguccagaaucccacuuucauucugucaacgugaaaauuuaaagauuuguaagugguacaauuauaaguucauaacuguauaggcaaaagaugagugugcuauaacauguaaaauagauuggagaagaaacgucugcuguaccaguaugaaaucugcaaauuaauuaggcagcuagagaaaacaugaaaagaaagucugaagggaaaaauacuaauacaauugaaucaguaagauuaaaaauuuaaugaaauuugggaagaagaaauuaaagaugauuuagguuucaagccuuaggucuaugaacugcacugaggaaauaugguucccaaacuucacagaucucuuacccauuuucuggaaugccauaucauauuuuaacuucuuuaaugcacuaaauuauuuuuacuuauggagugaaacauguaucuugcaagaacaugauauaguaacuaauaaauagauuaaagaaaucuggaggacuguaaguaugcugagcagggaagggaaugggguacuuauuacauuugauacaucauaacaugccaauuaaaaguagaauuugaacuucuguaaucauuuuuucauaaaaauaggagccaggauuccuauauccauuuguucacugguguauccccaaauuucuagaauggggucugguauauuguuagaacucaauaaauauauuuguuaaauguauauauaaaugagaaaagaaagaaguuauuaaauuuuaagaaagguucuacguuggucucaauguucugagcguucaauauucucucccaaucuuucuuuuauuaaaauagccuucuguaggugacucuauuuugaaaaaucuaaaacugugacagauuuaguaaaauguuauaauaaccacuuuaaauaauacuaaauuauuguauuaaccacuaaaagccaaaacaaaaaucuuaauguaucaucagacauaaaaauaguaauaucugagauuuuauacaaauuuuuagguauacuccauuuuuuggguuggcuccauuucacaguuuggaaauauuuuuaacuucagauaugugauauaaaguuaaaauuaccccuuacccacaugaucuucaaggcaaauauguuaguuacuauaugggaaaauuuaaaauguuuccuugcagaguuuaucaucuuaccaggucuuuccuucccagugccuuuugacucagcaaauuuuuguaucaaacuuucaacuguaguauuagccauguuauuuauaaauucuucauggaccuauuaaaaugaaauaaagauaacuuuuucuuuuuccacauucuuaguguauuucagauaaaacuuacacaagacaauuaaaauuaauuauaucaaaauauguauuuuugacccaaggcccuuugaggacuuuaauuuaccuaacuuccagcauuacuggaucuguagggaccaaccaugacuuacauuaaccccuuaacacauagccucacgccccuagaagucaaagcaguuuucuguucccaucuuugagcguucuagagacaucauucuuaugauaagacuuauacagacaacaaaaauacuuuuggcuuaaaaaaaacacacacacagucugacucugucacccagauggcugggugucacggcucacugcagccucaaccuccuggacucaagugauccucccaccucagccucccaaguagcugggacuauaggcaugcaccaccacacccaaaaauuuuuuaauauuuaaacaauuuaaaaucuuuuuuaauauuuaaacaauuuaaaaucuuuuuuaauauuuaaacaauuuaaaaucuuuuuuaauauuuaaacaauuuaaaaucuuuuuuaauauuuaaacaauuuaaaaucuuuuuuaauauuuaaacaauuuaaaaucuuuuuuaauauuuaaacaauuuaaaaucuuuuuuaauauuuaaacaauuuaaaaucuuuuuuaauauuuaaacuauuuaaaaucuuuuuuaauauuuaaacaauuuaaaaucuuuuuuaauauuuaaacaauuuaaaaucuuuuuuaauauuuaaacaauuuaaaaucuuuuuuaauauuuaaacaauuuaaaaucuuuuuuaauauuuaaacaauuuaaaaucuuuuuuaauauuuaaacaauuuaaaauauuuuuuaauauuuaaacaauuuaaaauauuuuuuaaauuuuguguagagaugaggucucccuauguugcccaggcuggucucaaacuucugggcucaaguaaucuuccugccuuggccucccaaacugcugagauuacagguaugagccaccgugccuggcuaguuugaagaauaacagacuucaucuuucucuacuauauuucaguauaccccaaauugucaucauuaaaccuuuuauauuuguggaacacuucuaaguaaaaguucuauaguuuaauaaaguugcugcuuuaaauuuaaaaauaguaaagcuugaaaaaagaaauauucaaaaguugauagcuuuagaaauucaauauaaagaaaacugaauauaguuaauuuaaaaaauuaauuugaauuaucauccucgguggccaaaugauaaaauauccaguuuauuuucuauuuacuacauguaaauauauuaucuuuacauauucuuuauuuggaaaaauucgguauuauacuuaugaacuuugaacagagugagaaaauauuuuuaaagagcuauaaauaaacaaauuuuucaugaauaguucaacauaaaguaaaaaaacuuaccuggccuaucugcaaaugaauuuccuuuauagcauuugacaaggauccuauaauuuccuuuaugugaaugagaugaguuucuucaauaucuugaaauuucuggguaacauauacaaaguuauagauuuauaacauauacagguacauacauauauauucuggaaucaaaagagcuuucagaaaucaucucucccagcacuuugggaggcugaggcagguggaucacuugaggucagaaguucaagaccagccuggccaacauggugaaacccugucucuacuaaaaauacaaaaauuagccaggcaugguggcagaugccuguaaucccagcaauucaggaggcugaggcaggagaaucauuugaaccugggaggcagagguuccagugagcccagaucacgccacugcacuggagccugggcgacagagcgagacuccgucuccaaaaaaaaaaaagaaaucaacucaauauaaccaaauuuuccaaguuaccacuuuuacacaauguuuaaccaagccucaagacagacagaucuagcagguaaacugaaauauggcacugcaaaaaguuaacuuuuuguuaugucauuucuuagguaaauacaaacuuuucuagaauuuggagcuuuuuuuuuuuuuuuuuuuuuugagacggagucuugcucugucacccaggcuggagugcaguggcaccaucuuggcucacuggaagcuccgccucccagguucacaucauucuccugcuucagccacccgaguagcuuggacuacaggugcccaccaccaugcuggcuaauuuuuuguauuuuuaguagagacggguuucaccguguuagccaggaaagucucgaucuccugaccucaugauccaccugccucagccuccaaaagugcugggauacaggcgugagccaccgcacccagccgaauuuggagccauuacacauuaaaaucuauaaucgugaucagaaaauuaggagacccagaagagaauaauguuacaaaaaaaacaaagaguuuuaaaaacugaaaaacaaucaguuggcaaagcaaaaacuacaguuuacuuucaaaugcuuuauaaucuagcccauagauuuucaaaaugucuuucuaauccuugaaauaauaauauacaccgggcacgguggcucacaccuauaaucccagcacuaugggaggcagaggugggcagaucacaaggucaggaguuugagaucagccugacaaacguggugaaaccucgucucuacucaaaauacaaaaaauuagccaggcgugguggcgcgugccuguaaucccagcuacuuggcaggcugaggcaggagaaucgcuugaacccgggaggcagggguugcagugagccgagaucacgccauugcacuccagcuugggcgacagagugagacuccaucucaaaaaaaaaaaaagaaaaagaaaaaaaagaaaaaagaaauaauaauauacaauccccaaaagagauggcugucaucaaagaaaucugggaaagccuauauacucuauuucagcaguucucaaccaaaagugaggauguguuagaucaccuggagaaccuuuucaaacuucaaaacaaauagauccuccaguacugccuggguaauggggguugaaagagaugagaaaguuguuuggaaaaaauuuccaaguuacucugauauccccagagaggaaaccacugcuugccuugccuucacaauaaauauaucaaaagcucugagaggccaggcacgguggcucacaccuguaauuccagcacuuugggaggccgaggccagcugaucaugagaugaggaguucaagaccagccuggccaacauggugaaaccccgucucuacuaaaaauacaaaaauuagccaggcaugguggcgcaugccuguaaucccagcuacuaaggagguucaggcagagaauagcuugaacccaggagaauuccuuaaacuugagagguggagauugcagugagccaagaucgcgccucugcacuccagccugggcgacagagugagacuccaucuuggagaaaaaaaagaaggucugagaaauacugaaauaaugacacguuucacuuugcuuaacccggcauuuucuaaauuucuuugaccuuacaacacuuuuguuuuucuucuucccugaacaucuauuaauaucucacagagcaauaauaguccucaaaacaggcuuugggaaaugcugagcuacccauuuucaaacaaaauacauuugucauuucuauuguacaaaccugguuaucuauuuuuuuccaaauuaaaucaguucuaaggaaugggccuaagccuuacuauuuuuaucuuguuaguuuaugaaauuuaauucccugacccuauauuuaaugucuaaauuucuucagucacuuuggugaccagaaaucaccaaaugauaucuaauguguaaaugguaagaaccucuaaaaaaaaaaaaauccagaauggugaaauuacaguuucggcaguauugcaacagcccaaaaacuugaaucaauuugauuuaugaggaauggcagaguuaaaguggaauacuugucauugauuaauuuugaccaagucaacgagaauacaguaccaguauuucaagauccugaauuacucucaagaacugaggagcauuuacuagaaggauggcccuuaacuuaaauuucagcaauuuaauaaacaagauauuuucucagacagguagccauuaauuucauuugaaugacccuuaauuccgaggaaacugucuucauucccuuuugaaaaagcuacacucaacaaggcagaucuuuauuuauuuagaaauaucuuaaaauaugaauccacagagaaacucaaggcaugaaucagaugcaauuuugaaacugugggguuuuggggguaggggcacacugcuaacuaucacaauuccucaaaauuagugacuacuaagcucagaguaauucagcaaugggaaauggauauagucucaaaugcuugaguauacauaaaugaacuuuccugaacaaauuagauaggcacuuuacucccugcaacuucaaauucacuguguucacauguauuguuacauuaauuuuuuuuuuuuuuuuuuuuugagacggagucucgcucugucgccaggcuggagugcaguggcgugaucucggcucacugcaaccucugccucauggguucaagcaacucuccugccucaggcucccgaguagcugggacuacaggcaugugccaccacacccagcuaauuuuuguauuuuuaguagacagaguuucaccacguuggccaguauagucucaaucucuugaccucgugauccaccugccgcggccucccaaagcgcugggauuacaggcgugagccaccaaacccagccuguuacauuaauuuuuaaaaguauagucaugagccacauaaugacauuucugucaacaacuaaugccauauaugacagugguaccagaagauuauaauagauaugaaaacuuucuauugccuagugacaucauagcugccauaacguagugcaacgcauuacucacguuuguggugaugcugauacaaacaaaccuacugugcugccugucacauaaaaguaccgcauagcacauaauauacagcacauaauacuugauaauaaaugauguuacugguaaauguauuuacuaaacuacacuuuuuauuauuagaguguaauccuucuacuuauuagaaaaaacaauaacuguaaaacagccuccagcagguccuucaggagguauucuagaaggcuuuguuaccauaggcgauacuuuuuuuuuuuuuccugagauggagucucgcucuguugcccaggcuggagggcaguggcgcaaucucagcucacugcaaccaccaccucucagcuucaagugauuucaugccugagccucccacgcagcuaggauuacaggcgcguaccaccacgcccagcuaauuucuguauuuuuauuaaagaugagguuucaucauguuggccaggcuggucucaaacucgugaccucaagugaucugcccaccucgcccucccaaagugcugggauuacaagugugagccaccaaguccagccagagaugauaguucuaugcaugcuacugccccugaagaccuuccaguaguacaagauguggagauaaaagagcaauccuaaugauacuaagccuauguaggcacauguuuacugugugcguuugugucuuaguuuuuaggaaaaagauuuaaaaaguuaaaaaaaaauaaaaauuuuaaaacagaaaaaaagcugaucgaguaaggauauaaagaaaauacuauuguacaacuguacaauguguuucuacuuuaagaugucaucccaaaagagucaaaauguuuaaaauuuuuuuaaguuucuaaagaaguuacaauaagcuaagguuaauuuauuauugaaggaagaaaacaauuuuuaauaaaauuuaauguaaccuaaaucuacagugcuuauaaaaucuacaguaguguacaguaauguccuaggccuucacauuuacucacuacucauucacuaacucaaccagagcaacuuccaguccugcaaucuccauucaacauaaguguucuacucagaugcagcauuuuuaaucuuuuauacugauuuuuacuauaucuuuucuauguuuaaagacacaaauaccauuuuguuauaacugccuacaguauucaguacaguaacaggcuguacagguuuguagcuuacaagcaacagacuaaaccauauagccaggucuguagcagucuacaccaucuagguauguguaaguaaguacauucucucuuuuuuuuuuuuuuuuuuuuuuuuuuugagacagagucucacucugucacccaggcuggagugcaguggcacaaucucggcucaccacaaccucugcuucccauuucaagcaauucuggugccuuagccucccaaauaacugggauuauaggcgugcaccaccacaccuggcuaaguuuuguauuuuuaguagagacaggauuucaacauauuagcaagucuagucuugaacuccugacuucaggugaucuguccaccucagccuccaaaagugcugggauuacaggcgugagccaccaugccuggccaggcauaaguacauucuaugauguucacacaaugacaaaauugccuaacgacauuucuuaaaguguaucccuguuguuaagcgacacagggcuacacuaucuucucagccacuaaagauauauaaaaguacgcuaauccuaauaaucuuuaaucugaggguacugcuuaacaaaucucaaaguuuccauaaacuagccaucucacugcuuuaaaguaaacaaaaucuccauauucuguuucaagugucucauuaauuaauagugguaaaagcaugagcauaaaaagucacaauuucaaucauuuuuauccuaaaccuaaauuuuaaaaacuuaaaucacaaauacucuaaauucuaaccucuuucacccuagagacucaaugaucuucucccacuaguaaauauagguccuaccacccaaauuugauucucacuauacugucagguucuuucuuucccacugagacuggucaacccagcuggccuggaaaaacaguuaaguggagaaguaaaaggauuacuuucccuucuaaacuaacccaaauuaaagucuauucucuaugaagaaacaauaauuaaccuauucugcagcuguagaguaugacagaaagagagggugagacagaaacagagaucucuaagaucuugagaaagaacaaauacacacacauuaguaaaguaugccaucaucuuuauuuaaaagcagcauggucacacauuugcucaaauaaauuaauguucccaucuuaaaaagggcagaaugggcuggcacggugccugugaucccagccagcauuuugggaggccgaguuggacagaucacuugagcccaagaguucaagaccacccugggcaacauggugaaacccugucucuacuaaaaauacaaaaauuagcuggacaugauggugcacaccugcagucccaguuacucaggaggcugaggugggaaggucacuagccugggaggcaaaaaggcugcaguaagccaagaucgugccauugcacucgagccugguugacagagugagacccugucucaaaaaacaacaaaaaacaaacaaaaaaaccagaaaggcaggaugaacaauuaaaaugccauuuuggaaaaaaauguaaugaggaagcagaacaugaaaaggaaauggaaagaugugcugaacgcucuuuuuuauaaaguaacaucaacaaacaaaaaacucugacuauagcaaacucuguuuauuccaauuuuaaaaauuaaugaaacggcaaaugcuuagcugauaaagacuaaccauuuaaugugaaauuaacauaucaacaauaacucccuuauaaaugugugcuccuaaugauuuaaaagacaaaacagcacuugcugaagccugcaaugaccucaguugcuacagaaauugcaacuuucuaucucacuagacuugaagccuuauuuaagacaacuaccuaaacccuuccuucuugaagcuucuuuuuccagcuaccaugacauuacacuuccaguuuucuucuuucuucuuuggcuuccucuauuaaaaucucaauaaugagucucucagagcuuggcccugaggcccuuucuuccccacacucuaaaagugcugucaucauggcuuuguguacugacaaaacccuauuuuauauggucugauaauccuuauucaaaacuuuugggaccaggcgaguuuuggaauuccuuuucuucccuuguuuuuuaaauaaagauauauaguauuauuuagaaugccauauaccucauucauaauacuaccagcaggaucuguaguggcaucuguuuaucaaacacauuaauauuucuaaaggaaaauauacguaggauaaagacuauagacagccucguaucaguucaagucaaguuuuguugucaaauaaaucacagaaaaaaaaauacuugguuuucagagcucuucggauucggaauuguggauaaggaacuguggacauuauguccagcccagauuacuuggcuccuccaaaacugcccuccugaugucaccaauuauguaucucauaggcgucuuaaaauuaacauguucaaaauugaacauugaucccuuccuuccaucaaacuaacaguucuucaucuaaucuuccccauucaucucucuccacauagauuuaacaagcuaaaaccuggaagggauccuaaucuuccgaagaauuccucaacccauccuaucccugccaucuccaaugcauucacuugucuccuucuccaagaccacuacgcuggcccucauccuucucaccugacuacuauacugacuuccaaacuggacucuugauucuccuuuagacauacucuaaucaauucuucccaaaacugccagaauuaucuuuaaauguagaucagaucaugucacaucccugccuaaaacccuuaggcggcuucuaguugcucuuagaagaaaaccuaaauucuuuugccauuaaaaguaacgguaaaaacuacaauuacuuuugcaccaaccuaauguaaccuaguccuuguguaucaauucaacuucauuucucacuaccauuuucccuuacucagguuuaguaagcauuuuuuacuuuccagaauguaaguucuuuuauacccucugggccuucauacucaugauccccaaagccuguaacgcucuugcccuauuaauuucuuacucacucuucaaguuccaguuuuaaacaucacuuaucuuaaaaggccuuuccugacucccuaauccaaauuaagucacugcuauuauucuaucucauggaagccuauuauuuuccuuugcaauacuuauaauaauuuauaacuuuauauuuaagcauguauuuaaugucugccucccuccucuauacuguaaacaccaucucaagcacggagauauuugucuuauuuacagauguacuguauacacaccagcaccuaacagagucuaugccauuguagguaaagauggauaugcacauacaugcacacaaguaugcaagacuucgcuuucuaagauaugagcuguucacuacuucaaaugggaagacauaaugaagacauagaguccaaaaauucagauucacaaaguccuucuuucauauuaacugagugccuacuaugaucugggaacuauucuaaaagcugaggauauagcaguaaacaaaacaaauccauccuugcucucauaaacuuaaauuuuaguggagaaaaacagacaaaaaauauagguaaaagaacucaugugcuucacuguuucuggccccuuagacauaacuaagaacauuccaaaaaggaguucauccaccagccucaggacuacagugaagacgauguaaaacagcugcagccaacccauaaugaacacgcagcaugagaaaguaauaaacccuugauauuguaagccacugagauuucuggggccuugugucaccacagcauacuuacucugaccugaaugauacaggaauaaaauucuugguauguaagaucacgauaggugcuaagcaggaaaauaaaacaaggaaaaggacaagaagcaggggcagcggagaguggaaauguuagguaugauuccuaaaaggcagccaccuuaaacgaggccuuuaauuaagguucuaagaacacuacaccaaauauaauuuaucccaagcuaauggauggcagacauuugugucugucuucccucacuaauauguaaguucuuugagaccagggauuuuuuggguuguauugacugccguagccucacuacuaagucacuuccaguuuucuuauuaaugcuucuuaagcacugucuucaucauguaccaaugcccucaguuuccccaauuaccuuuaaacaggcucuucugaucuaccuguauaauuccuuaugacauuauaauuauugcaucuugguccucaaucuccaaaacgcgacauguauuuuuaaaacagcaucauuaacaaauugagauugugcauuuuaaaacuuccaacacuaaaaaauuauaugagagaaaaauuaaucaauauacacaaauauaaaugcccuguuuucaaucugaagccuuaaaauaccaaccugagcuguuucugucauuuucuguucgaaaucagcuuuugcuaaugcauauuuuuccacauagaguuuauagguaucuguagcuuucuuagauuuaacagcugccuguaauaaaauaaaauaaaaaacuuuuaacugugcauugaccuuuuuucuuuccuaauguaaguuaauaugaauaacaaauuaaaauacauuuuaagaguucaauaugacauauaacuaacuuugauacuuguugugaggcccucuuuagucuuuuuuuauuguuguuguuacagucagccaagaagucaggaaguaaacacugauucucuuuucuguuugauggaaugugcuuugaaaaguuaaaauacucucauuuuaaaucccagacuaagauugcauaauuacauuauaaugcuacaguguuacuaagauauguuaacacacuguuggagagaaacuuccagacaauauacaaaaaugucacaauaccaccagaacgugcuugacacuccuuuucgcagcugugaauuuuccuccaccacagcauacauauauuucauucaaugucugauuaaaccuaucuauaaacuauaaaccuaucucgaaaguugugaaggcugguuuccuugauguuucucagcuuccauuaugcuccagcaaauacagaaacuuguuuucaaucuuugccuauuuuuucaagacuuaaaaaacgaaacuguuaccauaauaguauaguucugguuuuauaaguuacuuauuuaauuaaaaaaacauauuaagcaguacuguacaaccuauacauaaacagaaauugcaauaaaguaacacagccacagaaguuaagguaaauuauaagaagauaggcauuugagaaaggaaaagauuauguguaguuuguagguugaagcagauacacagcuaucaagaagcuugauauucucaaaggccugaucaacuuggauacaggaagauggagugaugugguuggacuaaaaaagaguuuaaaggagaucaaagaaagacaagcuauaggauuucaagauauaaaaauccccauuuucuugacgagguaacagaugggucugguaugagugagaaacaguaggguagguugggagcuuaaggagaacaaaaaaaguuucaaaccauaauuguggaggaugcaagagcucaugacuagaugaauaaaaguguugcuaagugccacugaaguccaaggaaagcuguaaaauacuuaauuuguuuaaagccgaucaguaccaauauguaauuaucuuuagccaugaucaggaaucuaaaaacaaaaaacuacaaagagaaaacuggguuuacccugagguuuggguuugguaagagguacauauaguccuacucccuaaacaagcaacuuuguacucucucuaaaauguaauuguuuauacuauauuaaguauauauguuauguacuuuccugccuucuuaaagaauauaggaugccacuuuaccaugaaacauaaacaaagcugauuuuggagccagaagaaauucaacugaaauucuggcucuaccguuuacacuacugccccuuuauccauggggaauacauucuaagaucccaguagaugucugaagccauggaugguacagacucuguauuauauacuauguuuuuuccuauacauacauaacuaugauaaaguuuaauuuauaaauuaggcacaguaagagauuaacaacuaauaaaauauaacaauuauaacaacauacuguaauaacaucauaugugaauacggucucucucucucuaaauauucuacuguacuggacaguagguaacugaaaccaaggaaagugaaaucucagcacugcacuacccaucugaccuugucuuagaaauuuauacaguucucucauuacuaaaaagggaacaauaucaccuuuuuuuuaaaaaaagcuguaguaguaauguaguuauacaaaaugcuuggaauagggucuggcauacaguuaaauuuaaaaauaaauagugccugcuuuuauuaugguuucuaacaagaaauaucaucaagaaaacacaucaugauauuuugcuguaauauaaagauauauccgaguuacugaguuguauugagcugccuaucccuagcgaaagugacuaaaacccguaacaauuuucuaguuugcuccuauagauuuuuuuuguuuuacucuucucccaguuccacacagcugacauuauuuuauaccaguuacuggaauccucuaauauccugccccuguucaaauacguaacagcuaaaugaaauggauaguuuaccaaguaccuucgcaagaaacccagauaaccaaguuugcuagaauuuauuuuaaaaacaauuauaauggcaugcuuaauccggguuuccuuuuggauuuuuuuaaugcaaauaaauuuuaguuuguucuucuaauaccuguauuuucagugaguauaagagcaaucaaacgaccuacaguccuucagagugaauuuuuuuuuuuuuuuuuuuuuuuuuugagauggagucucacucuguggcccaggcuggagugcaauggugcaaucuuggcucacugcaaccuccgccucccggauucaagcgcuucuccugccucggucucccaaguagcuggaauuacaggugcaagccaccacgcccagcuaauuuuuguauuuuuaguagagauggggucucacucaccauguuggccaagcugaucucgaacuccugaacucaaaugauccacacgccuaggccucccaaagugcugggauuacaggcaugagccaccacacugggccuucagagugauuuuuaaugacacagccuagcauaaugauguaacccuacugaaagccccuucuuugcuuguuccuaauaccucauccugauaccuacuuuuuucuuuuucucugcugcucacuaaauuauugcuuaauaauuuauaugccagcuauugauaaagacaaguugugaucauuccuaauacagauauuuacaagucaaaaggagacccauaaaacuggaaaauuccaaaaauaccuaauuauaaugacugugcauacacuuuuacaaguaauuuacugggcgggcaugguggcacaugccuauaaucccagcacuuugggaggccaaggcaggaggaaucacuugaggcuaggaguucaagaccagacugggcaacaaagugagacccugucucuacaaaaauuuuaaaaaaauaaaauacaauaaaaauuuuuaaaaaauaagccaggugcaguggcucaugccuguaaccccagcucuuagggaggcagaggcagagaauaguuugagcccaggaguucgagaccugccugggcaacauagcaagaccccauucuccaaaaauaaaauaaaauaaaauaaauuauccaggcacagugacacacaccuguggucccagcuacucaagaagcugagguggaaucacuugagccccagaguucaaggcugcagugagcuaugauaauaccaccacacuccagcccagacaacagagacccugacucaaaaaacaaaaaaacaaauaucauaaaaauaaaacgggaaagauugugugaaauaaauuacuuuuuuaaaaauaaauuucuuuuaauagcaauuucuuuugagacaaacaccuagcagguuuucuuuuuauagacuguguacaaaauaagauaccacaccuucucaacuuaccauucaacccucucucuaacuucuuguucuguacuauuuaauaugucuuggcucuccaagaaaaagaaagcuucuugaagacagaaacaauaacauguauuuagccuuaaaaacauucauaguucccagcguggugauaggcuaggaacuaaacauuuauuuacuguugcaugcaaauuaucacuucaugauauaauggcaaaucagaaaaauauuugaauaaaucauuuuaaaaaguaagcaucuauucuaaagccuauagcuaaaauaaacucaaacuaauuuuauuauauuaaugaaguggaagaauucaaauaauauuuugcuaugauuauuuuccaaguaaauauauaugcuguguuauggacaaugcaaugauagcuucucacuaacaagaaauuuauaaccuaauagaaauaaaggaugacuacauggaggaacauuacuacuuauaaaagacauguauuucuaaaguauaaacaaagaaauuauuuuauaacacuaugcaucaaacauuauaggccuuuaagacauggagggaagauccugaaucauuucaucuuccuauacucacguagucucuagaauucuaacuaauuuugcuacucaaaucucuacugagucaagagggauaaaaccauuaaggcuuuuacaccagcauauuuucauaaauuucuuuuuuuccucucaugauauucucacuauaaauccuggucuauacauucagcacuuauuuguucacuacuucuggcuauaaaacuauuaucuuuaucucaaagguuaacggcuggaucuaaaucaaaauuuuaaacaaagaaguuuuaugaagcguacccucugauaucaggaaauuauaaaauuuuauuuaucuuauuugaaagcaugaagaaagaagguacucuuuuuaaguucugacuuauauuuuuucaaucagcucuuuuuuuuuuuuuuugagacaggguaucacucugucacccaggcuagaguguagccucaaacuacugggcucaaguacuuuagccucccaaguaccuaggaccauaggcacaugccacuacgccuggcuaauuuuuuuucuuuuuuuguagagaugggcucucacuguguugcccaggcugguuuugaacuccugggcuccugccuuggccucccaaagugcugggauuaccagcauaagccaccaccaugcccagccuagcucucacucuugaaagguaaaauugauaugccacagucagaauccuaaggaaauuacaaaucaacuuuaagaagcaucuuuaauacaagaugauagggagaaaaaaaaugaaagaaaaaagaaauagagaagcaucuagaaaacugacaagagaagcacuaacuaauaaagaaauuucuuuucauuucuuuuuuuuuuuuuuuuuuuuuuugagacaggaucucgcucugucaucugggcuguagugcaguggugcaaucauggcucacugcagccucaaccuccuggccucaagcaauccuccuccugccucagccuccugaguaguuaggacuacagguaugugccaccagucuugcuguuguaggccugggccggaaugcaauggugcgaucucacacugacuaauuuuuuuaaaaacuuuuuguagagauggggucucccuacguugcccaggcuggucccaaacucccagccucaaguuaucccuccacccuggccucccaaagcacugggauuacaggcaugagccaccaugccccaccagaaacauguauauuuucugaaagcaagaaacaucuuucauaagaaacagcuacacaauacuaaauuauuaagucaaaacaacuuucuaaauaacauauuaugcuuaguuaggaaugcuauaaauucuuaagguagaauuauagaaacugaauggccucaucauaaaaaagugacaaucuuuauagucauuauuaaaagggaaguugggccaggugugguggcucaugccuguaaucccaccacuuugggaagccgaagcaggaagauggcuugagacuaggaauuugagaccagccugugcaacaugagaccuugugucuacaauuuuuuuuuuaauugagacagcguuucacucuuguugcccagacuggagugcaaugccacaaucucggcucaccacaaccucugccuccuggguucaagagauucuccugccucagccucccgaguagcugggauuacaggcauguaccaccacgccuggcuaauuuuguauuuuuagcagaaaugggguuucuccauguuggucaggcuggucucaaacucccaaucucaagugauccgcccgcuuuggccuccuaaagugcugggauuacaggcgugagccacugcccccagcuuuuuuuuuuuuuuuuuuuuuuuaagacugaguuucacucuuguugcccaggcuggaaugcaguggcgugaucuuuguucacugaaaccuccaccuccccgguucaagagauucuccugccucagccuccugaguagcugggauuauaggcacacaccaccauacucggcuaauuuuguauuuuaguagagacaggguuucacuacguuggccaggcuggucucaaacugcugacaucagguaauccaccugccucggccucucuaagugcugggauuacaggaaugagccaccgugccuggccugcaaaauuuuuuuuuuuauuggcugugcaugguggcacaugccuguagucccagcuacucuggaagcugaggugaaggauugcuuaagucugggaguucaagguuacagugagccgugauugugccaaugcacuccagccuggaaaacagagggagaaccugucuugaaaaauuaauucacuaguuaauuaauucacuaauuaauuaaaauaaaagggaagcuggagcauuuguucuuaagaggaaacugugcuuuacaaguaauagcuacauuucuucucauaagcaagaguggcuuuaauacauuaccuaugauaauaaaacaaaucuaaguuuuauucauuuccuuagcauuauaaauuaauauacuaccaaaaacauuuuaagugccuaugacuuuuauaguacaauccaugaagccagcauauacauauaaaaugaguacuuagucaauaguccacaaacaugaguaccuacuaagugguguuuuauaaaaaugaaggcuugugguugggugugguggcucacaccugugaucucagacuuuggaaggcugagacgggcauaucaccugaggucagaaguucaagaucaggcuggccaacaaggugaaaucccaucucuacuaaaaauacaaaaauuagcugggcguggugacgcaugccuguaaucccagguacuugggaggcugaggcaagagaauggcuugaauccaggaggcagagauugcagugagccaagaucgugccacugcacuccagccuggguaacagagcgagacuccaucuuaaaaaaaaaaaaaaaaaaaaaaggccugugaaugagugaaugagauaaccaaauuauguuauaacaccuauaguauuuauguuuuuaagucacaaaaaaauuauucaaagaucuaugacuuuuaaaaaaaaucuacauucuuguuaauaaaaaccuuacgauaggccaaaauaacugacuuggauuaaaauauauuacaaaucagagaacccacuaucuaauaucacaagcagagaugccaccucugaggagaccaauuagaaaaaagcaccccuuccucugaguaguccaucccacugaaguccaucccugugaagcacagggugaauuuuagccaacucacaacccuuggacacaacuacaugcuccacuccugcucaauauuuuaauaaaaaagaaaucaugagccgggccugaugauucacaccugugaucccagcuauucgagaggcugaggcagugaggugaucgcuugcacccagcaguuccaggcugcagugagcuaugaucauaccaccacugcacuccagccugggugacacagugagaccucaucucuagacaaaaaaaaaaaaaauccuuuaauugcaucuaaaucauuacauuaaacuuguuuugguuuacaugaaaagacucagaaucauuuauuuauguguaaucgcuagucaucauauauuuuuugaguggucacggcauacuagguacuauggugagcccacugggguucacaaaaaagaagacaacgguauuuaacccagcaguacuuuaauccucuggauaguuuuaacuaauuuagaucauagacauuugcauuaaugauaugaaacccauaccaauucacuguugggcaugaauguuauaguaucuaccaagaguaaacugcuccugugacuuacauuuuuuuuuucuuuuuugagacggaguuucgcucuguugcccagacuggagugcaguggcucgaucucggcucacugcaagcucugccucccagguucacgccauucuccugccucagccuccagaguagcugggacuacaggcgcccgccaccacgccuggcuaauuuguuguauuuuuaguagagaugggguuucaccguguuagccaggauggucucgaucuccugaccucgugauccacccaccucagccucccaaagugcugggauuacaggugugagccaccgcgccugaccacauuuuuuaaaguaauuauuuuauuuugaauaaagucagcuccugucccauuccccuuacauucucaucacaaguaauuuccaucaugugcuuauuguuuacuguccccauacaugucccuaauacuuuaccuguauauaaauagcauuuuuuuuuucaguuuuguacaagaguuuagaaaaaaaaaaaucaaaucacaacaaagcugacuuggcuucucuuugagccuccuggaucaccauauaucuguggcucuggcggguccugccgcuccaccacaaacacuguuuuaguucuccuaggccucugccugucucccagccugaacuccauucacacauggagugugaacacgaaguuagagugaggcugcuucagggucccaggcccaugcguccauccagacuccaaguggaguguagggcuuccagggcagagagggguuggaggggcagacccugcccaggcaguccucacauuggacagggcaucaaacgguaucccaagggcucgcccucccuuucccccaaccccaacucaggugaagggggagcagcugucaccagaaccuauacuggugaagguugcggcucagcacggaacgaacaucagcggugaaccugagggcauccagcaucgggagcagguugagaaggguugugucacuggggucacugaaccaggauuugauggugauggccuugucuggauggcuccuguaaaccccuggagaguuagccaggaucacaaugcuggagaggucacuguggaccaaagagagguccuugauguagcugcccaacuccaaagugcagugcuguccguaguaucucgucuuaagaaugcuucugcuauuguccaguuuaucugccacagcagagccauagaucuccaugcuugcuauaaacacuaccagcucccaccacucgcucacgacuuccaaaaagaaauccacauggggccucuaauguacaaagaaacggacaggauguuugucuauuaccaccuugaggaugaagucaggaggcguuccaggccagacugugagccucaggaccccaucauggugggagugaauaaguaucucauccggauccagcaccaugaucuuccucuucaccuagcugauuccaggacaagaagauaaggggaugauaucauaucgaacaguuuggugcugaauuaccaugcagaucugccaccgcaaaagggcggagaagcuccagagcuuggcggcgaaggccacgaacgugcgcagccccagcagacacugcguccgcaucauccugaugacccuggcacugccugcucugccggccccgccggccccgggggcccccguggcacagcuccgccagccccccguugccgggagggggaacggcagcccuaaguggcaggagaggcugcagagagggguauggagcaagcggcucagaaagucaccccuggcgagguuuuggaaagcccagcggaacggggagcuggcggacaggcguuggcagccugcgggggcccacaugggcugggaguggcaccaacagcuucggggaaguugcgggccgagacaggucgggcuaggauuggguccuccgagaccaggagggaaggggaaggauuaauuggggaaggggacagugggggagggagcaaggaugaagggguaagggagggggguaagcagagagucaauagcuuuuuucuguuuuuacagagaauuaaagguuauauaaaaggcaucaaauucuacacauccuuuugaaacuuuuucuugcucaauauuaugcuuuuuacauuuacucacguuaauacaugucauucuuuuuuaacaugaauccaucaccuagcuucaagacucaaucuauucuuuccccuuuucuuugcaagaguaauauuuauuuaaacuacuguauuguaucccauuauaugaaauacauaacaggauuuuuuuuuuuuuuuuugagacagaguuucguucuuguugcccaggcuggacugcaguggugcgaucuuggcucacugcaaccucuaacucccggguucaagugauucuccugccuuagccucccgaguagcugggauuacaagcgcccgcuaccacgcccggcuaauuuuugucuuuuuagcagagaagggguuuugccauguuggccaggcuagucuugaauuccugaccucaggugauccacccaccguggccucccaaagugcugggauuacaagugugagccaccaugccuugccaacaggauuuuuuuuuucaauuugacaauugaucuaugauuagaggagcugcuaugguuugaaugcuugugaaacuuaauccccaaugugacgguauugagaggugggaccuuuaauagaugagucggucaugaaggcucugcccucauaaauagauuaaucuauuaauguauuaaucgguucaugaaucaauggauuaucauggaaauaggacugacagcuuuauaaggagcaaagagagaccuaaacacacucagcccccucauaugagguccugcaccuucugagaauucggcagacuccccacaagcaagaaggcucucacuagauguggccccucaaccucggacguccuucucauccuccauaauuguaaaaaauaaauuccuuucuuuauaaauuauccaguuucaagccaggcaugguggcucacacccagcacuuugggaggccaaggcaggcagaucgcuugaggucaggaguucaagaccagccuggccaacauggugaaaccccaucucuacuaaaaacacaaaaauuagccaggcgagguggcacaugacuguaaucccaacuacucgggaggcugagucaccagaauugcuugaacucgggaggcggagguugcagugagcugagaugcggcuacugcacccuagccuggguaacagagugagacucugucucaaaaaaaaaaaaaauuacccaguuucagguauucugucauaagcaacagaaaacaaaccacaccaggaguccaagacauuuauauguauuaugauuauuucuuucaaauuauuuucaguuuucuguuuacugacaaagcauuuccuuuuuuaacuuuuauuuuagguucaggggaacaugugaagguuucuuauauagguaaacugugugucacggggguguggugcacagcuuaugcgucauccagguaauaagcacaguaacugacagguauuuuuucugauccucuccuucuucccuucuccccacccucucuccuccaguaggccccagugucuguuguuccucucuauguguucucauuguuuaguucccacuuauaagugagaacaugcaauauuugguuuucuguuccugcauuaguuugcuaagaauaaugggcuccagcuccacccauguucccacaaaagauauaaucucauucuuuuuuauggcugcauaguauuccacaaugaauauguaccacauuuucuuuaucaaaugucacugaugggcauuuagauauugugaauagugcugcaauuaauauucacaugcaugugucuuuaugguacaacgauuuauauuccuuuggggauauauccaguaaugggacugcuggggugaaugguaguucuguuuuuagcucuuugaagaaucgccacacacugcuuuccacaauggcugaauuaauuuacacucccaccaacaguguauaagcauucccuuuucuccacaaccuugccagcaucuguuauuugacuuuuuaauaauagucauucugacuagugugagaugguaucucauugugguuuugauuugcauuucucugaucaucagugauguugagcuuuuuuucauaugcuuguuggcugcauguaugucuucuuuugagaagugucuguucauguccuuugcccacuuuuuaauaggguuguuuuucucuuguaaauuuguuuaagugccuuauagaugcuggaugucagaccuuugucagaugcauaguuugcaaacauuuucucccauucuacagguugucuauuuacucuuuugauaguuucuuuugcugugcagaaaccauuacguuuaauuagauccuauuugucaauuuuuguuuuuguugcaauugcuuuuggugucuuugccaugaaaucuuugcccauuccuauguccagaaugguauugccucaggugucuuccagaguuuuuauaguuuuggguuuuacauuuaagucuuuaauccaucuggagaugauuuuuguauaugguguaaaaaagggguccaguuucaauuuucugcauauggcuagccaguuaucccagaaccauuuauugaauagggaauccuuuccccauugcuuguuuuugucaguugacagaccauuucuuucaagugcuccauuauuaucuucagguuuucuuccaagcacuugaucuuaccaaaagguaucacuaaaagauuuucagaaaauaaucaaagccauuacuuccucaaaugguccuuaaaaggucuguuaacugaaauaucaaagcauuguagcuguccaaucaugcaacgaaguuuguacaggcaauucaacuacaccauaaaagcuaucuuaccaaccaugacuauacaauaccaucaauugaaaaugcauucugauuucauaugaggaaaaaaaaauacccauuuucuuuuucucuggggucuaggucugaauuuauuuaaccugcuuaauaccuauaauguacuuucaauaugagggcucuugaauuucuucaauucugaaacauuuugagcuguuaacucuucaaauauuacuuguccuuccauuuccuccauuuuuuccuucugaaauuaguauuagaugaauguugguaacguuugcuucuccuacuauguucuggauaaggucccuccauacuaucuucaaaacucauucuuugacuauaucaagucuaaaguuucuuuucucuauugcuuuuuaaaaaguucaauaacucuauuuuucauuuccaaguuuucuaauuagcuguuuuuuucuaucuaguagaucuuguuucauuacguuuaauuucuuaaucuucuuuaauguaaguuuauguuuauuuauuugaacauccucaagacacaucguuuuuguucauuuuuuauaaauuuaaauuucaucuggaguaaauucuuauuccaauuauugaauuuauugguuguucuaguauuagauuucuuaggugugugcuacaauuuugguuguuugcucauucagaauaggaguuuuuuuuuuuuauuuugcccucuuuucucuucuucucucucgcccuucaucaguacugcuggacauucauagaauaaaacauaaaugguaccuccuagaauuguguuaugcuuuauacuuuaugcucacccauccccaagcaguuuucagguuaucuccugccaccccuccaaggccccaauuucauuucagucuuaugaaaguaauuuuuaauuacuucccugcaagaauauuguagauauggccaaaauagucaugaaaugauuccuuggcuugauuucaagucaggauugugucucuguaucugugucccuaaauccccaacuuucaauaaggcuuuaguucuugucagcaacccaagagccuucuuuucucccuaucuauaguuucaggcaaugagccaggcucuuuguaccucauccuaagaggggagcuuuuagucccuuuugccacguaagagccaaaucccacugccuacuuuaggacuuuugaguucaacagcuugcauaaucaaucucuacgugccauuuuggauuucuguucuauucuggcccacagagauaaaauauuauucuuuuuggacccuguuauuucguuuucccuuuuuauauuuuauucauaauugcuaugucugaagcagaggguguuuucaaaccaugaauuuacugugucucauuuuggccccucccaauuuuuauuauacaaauccaauuuuuauuuauuauacaaacacaauauauugcuccaaauucauuuuuuucaucugugacacaguccccagaagguccugagauuaugugccuuauugcuccaaauucuaaaucaccuauuuucauuuuuccacauucucuucuaguuuuuugcccauguauagucauauaucauauuucauugguuaguuguuuaaaauauuuuggaccucagguauauagaaauggauuaauuacauuaucacaagucuuguaacagccccucuuauuuaauuauaugauauuaauuucugaguugauuugguuauucagacuuguaacagaagacuuucuaucaucaucuguuguuaaaaauuaacucuuaucaaacuucaauguaaaacuaguauuccguuuaauaugcuucaucaaaaauaaaguaucugugcauuuaaacauguaaaaguauauaaauacacagcuguuuuauagucauaaucauacaauugguacaauuugguuuccuuuuuuacuggauauuucaaacauuuuacaaagcuuucaaaauuaucacuccacauggcucauucuuaagugagauauaccacaucaaauaaguaaaugguuaaacuguuuugaaaggagaaaaaaaaagcuacuuuccauuaaaacauaaauggaagaaaagguugugguuuaccacaaugcuacauaaaugugcucaaagucagcaauaaaucaccacaacacacauuuaaagcuuaugugcaaguaccuaccuguaucuuucuaaauauaccaaaaucuuguuucaaaacaauuuuaccucaugguuaaauuuuacacaaaguaauuaccucaauuauguuacuacaaaaauauccugaaaaugugucacugacauuuaaaaaaucauuguuuuuugguuggguguaguggcucaugccuguaaucccagcacuuggggaggccaaggugggcggaucaccugaggucaggaguucgagaccaaccugacuaacauggcgaaaccccaucucuacuaaaaauacaaaauuagccggauguggugucaugcgccuguaaucccagcuauuugggaggcugaggcaggagaaucacuucaacccaggaggcagaggcugcagugagccaagaucgcgccacugcacuccagccuaggcaacaagagcaaaacuccgucucaaaucaaucauuguuuuuuagugcucgcuaaccuauuuaccacagauaacauacuuuacaaaucuccuguguuuuacuuggguaaucacuaggacuguaaggcacagugucuucaucuuuaaaaugagauaauuuucaguuugaucuaaauguuaaaugcaauuuuguaugucaaggugcuuugaaaccacagauauguaauuuuuauuaugauuaccuuuucuauuucucuuuguguagcuccuuccuuuuucaaacgcuccuguucuacacacuuggcauuguaauuuuccuuggauuucuggagggccugaguuaugcucugaaugguuuggacagcuuccagaguuccugcaacuucuucuuuagucuguuuaguaugaaaugauccaucaaaaugacugaacuauaaaguauucaauaucugaccaaucaauuauuuaacaagaaaaaaacugauaccuuuuuaugagacuuuacuuguucuucuccauacuucugaacuuccuuuauuaauucuuguaauuuucuaacaagauccaagugacaauuugcuaauuucucuguagauguuuugaauacaucccauacuggugcaaauguucuaagaaaauaaaaaauaugggaauaacuuauuaaaaguaaaaaagaaaauuaagguucuaacaaggaaccaguggaaauaauagugguauauauggcaacuuuauuuaggcaaaagaugaaauuaaaauaaugaauaaaaugauugacagacugaccuugaauuuuuuuugucauugguuauuuaaaauauuuuuggaccucaggaauauagaaauggguuaauuacauuaucacaagucuuaacccucuuaauuauauuaauuucugaauugauuuaguauuuauacuuguaucagaagccuuucuaucacugucuauuguuaaaaauuaacuauuaucaaacuucaauuuaaaacaaguauuccauuuaaaauacuucaucaaaaauaaaguuucugugaauuuaaacaugcaaaagcccaauuuuuagauaauuauucuuuccauaauuguuauggcaaugagcacaucucauuuuaaauguauucuuuucauuauuuucauuuuucaaggaacacauuuuuaauacaaauuuuuaaaaggaagauuuaaugacagucuauaaaaucacaggagacauuuuuaaugcaucuuaaucauuucaauaaaguuuaucuuaagugaguuuuuaaagaucacuguuaaacuacaacagaauuuaaauaggaacuuacagacaacuagaauaaauacauugcaugugcauaagauaacauuuauaaucucaaacacuauugaaugacuaguuuuuaaaaagggaaaaaauaaauuucauuuaguuuugacugcauugacugauucagcaaguucaauuauauuuucuaucaagugaagaauauauuaauauuuacagauacuuuuaaauaagcauauauuuuacuaugcuuuugaacuguuauguccucaaaaggaaccuagaauccuuaagaacuuugccuaaauaaacacugaaaaagaggaagaaauuaacucacccaaguugugaauaauugcuugcagauuuugcuaguuuugucauugaccuggaguaugccuccucuaugguagcucuguuaaaucaaauauccacaucauaauacuucuuauuuagugaccaaaaacagcaaaguuaucaaaauacaauuaaaagugcaaaacaaaaagauaccucaaaaauuacauguuaaaaauaaguacauauauguagucaugaauuuccggccuaucuucaaauguccuuucugguauagaacuaaaauaauuuauaucacacacacaaauuuuuuuuuaaaacagucuugcucugucacccaggcuggaguacagugguaugaucauagcucacugcagcuuugaccuccuaggcuuaagcaauccucccaccucagccuccugaguagcucacacuacaagcaugccccacaacacccagcuaaguuuuguauuuuuuuguagagauggggccuugcuauguugcccaggcuaaucuggaauuccagggcucaagcaauccucccaccuaggccucccaaagugcugagaucauaggcaugagccaccacgcucagccacagaaaaaauuuuaauggaaucacaacucuuuuuaucuuuaguaccaaugcuuaucugaacaggaaauacaugagugcuacuucuuguauucucucugucucuguaagcugguucacugugauaagugugucauuuguauuuaauaauucuuuguuguacuuaguuuuauuauucuucaacacugugaugcacauuuaauagaacaagagauuaaugacagucauuugcacaaaacuaaauauaucaucaagucugaaauccugaacuucauucauggcuuaauuuauuuugugaucagaucuaaaauauuagcaaauauuucacacuagaaaacuguguuuuauauaacuacuguuuagcauaugagauuuuauuccguaaaaaacauccacagccauuaaauauagaauucuaaaagacacaaauuauccuacagacauguaaccuauaaauacagaauacacauuuuguauggccuucuuuuuuugagacggaauauggcucugucacccaggcuggaguacaguggugcaaucuuggcucacugcaaccuccgccucccggauucaagcgauucuccugccucagccucccgaguagcugggacuacaggcacccgccaccacacccagcuaauuuuuguauuuuuaguagagacaggauuucaccauauuggucaggcuggucucaaacuccugaccuugugauccgccccacucagccucccaaagugcugggauuacaggcaugagccacugcgcccggccuguuuggccuucuuaacacuacaaaacuuauaguuuuaccuuuugccuggcucuucucaaugugugcuacccuuaauaggggaacauucuacaaccaccaucaucccuccauuuacuuugauugguccaaccaacuuucugcuucuaaugucuaaauccagaucuucacacuacucuugcacugacccaccuguucaauaucuaacugccccaaacauaauuaagauaugugaaccaccucaaacucagaauaucuaaacuaaucuccaaacucuuucccaaccaaauuugcacaaaaaccagcucucuaacaaaaaggaaauauuaacaguaacugccucucgcugauaguacugugacucuuuccugcuccuuuaaguucuucugucauuuuaaaauacuauuacuacaagaguaauacuuuguucacccaaaaaaguuaauauuaguauaucaaugugugaguuuaacagcaagguaaagaaguucaauuuccaguacagauuaaacaucccuaaucagccaggcacgguggcucacgccuguaaucccaguacuuugggaggccgaggcuggcagaucaccugaggucaggaguucaagaccagccuggcuaacauggugaaaccccgucuguacuaaaaauacaaaaauuagcugagcaugguggugggugccuguaaucccagcuacuuggaaggcugaggcaggagaaucgcuugaauccgggaggcggaggcugcagugagccaagaucaugccaccgcacuccagccugggcaacaagagcgaaacucugucucaaauaaauaaauaaacaaacaaacaucccuaaucaaaauaucagaaaugcuccaaaaucuauauauuuuuugaggaccaacaugaugccaaaagcagaaaauuccacaccugaccucaugacaggucauggucaaaauucagucaaaacuuuguuucauguagaaaaauaguuaaaauaggccgggcacgguggcucacgccgguaaucccagcacuuugggaggcugaggcagguggaucacgaggucaggagaucgagaccauccuggcuaacacggugaaaccccaucucuacuaaaaauacaaaaaaauuagcugggcuuggugacacacgccuguaaucccagcuacucgggaggcugaggcagaauggugugaacccgggaggcagagguugcagugagccgagauggugccacugcacuccagcugggcgacagagugagacuccgucucaaaaaaaaaaaagaaaaaaaaaagaaagaaaaagaaaaauaguuaaaauauuguauaaaauuaccuucaggcuaugaguauaugguguguauaaaacauaaacaaauuucaaguuuagacuugggucucaccuucaagauuucuugcuauguauaugcaaauacuccaaaaucugaaaaaaauccuaauucuaaaagacuucugcucccaagcauuucaaauaagggauacuuaaccuguaauagugaauaagauuauugacacaaaaacuuuucucacugaggaaaauuuagaaaacaugguaaguugagggugggggcaagguaacugaaaagcauuagaaaacuuaaggggcaguuaagaaucaagauccaagagaagggcauccagacaagucagucagguaugucgggcagcuucuuccuuggggguauccagaagagguagcugaucaguugagaagugaaacagagcuuuucucagccucacagguuaagggagccaaaagaaaaagaguucagguccacuaaagguagaaagcagagaaaaaucccacgcccuucaaguaaagacuccaaaagaagaauuucauuagagaucuggucauuuuaagaaguggaggaaagcacaccaaauuugcaaaaaagaaaaaaaaaaugcaaauuacagaucuagaaaauacaacaaccaaaauuaauaucuccuuggaugggguuuagcagcugauuagauauacuauauugagauuuauaccauaaaaaggagauggagaaaaaaaaggaaaauuuaaaaaauaaagagaucuaguuaauuaaaagauagaugagaauaauuuauccaacauugaaguucagaaagacaaaaaagaaugaaaaacagagaagagauguaaaggacaaagcaagaaaagucagauaaaugaguaaagagaaagaaugaguuagagaaaauauuugaagaaauaauaauggggaauuuuccaaaacugauaaaagauauuaaccacagauccaagcagcccaacaaacuuuaagaggauaaauuguuuaaaaacaauuacaucugguucuagucacauuagaguaaaaaccgcugaaaauuaaaaagagaaagaacaaaauaaaucuugaaagcaaccaaacucuucccaccaccaaauguuaccuucaaagaaccaauaacuagacugauagcuaacaucucaacuauagauaauggaacgaucuucaaaaaaaauuaauuaaaaaaaucuaccaacuggaauuccauacccagcaaaaauauaaaugaaagcaaauccuuaauaaaauaacagaucuaggugauuaucaccaauggccacuaacaucaugaaacaguuauauuuggauaauauaugccucugguggaaguacacaccaccaccuaagaaguauucuuuccaaaauacugaauagaggcgggcgugguggcucaugucuguaaucccagcacuuugggaggccgagguggguggaucaccugaggucaggaguccgagaucagccuggccaacauggugaaacccugccucuacuaaaaauacaaaaauuagaugggcgugggggcaugcaucugcaaucccagcuacucggggaggcagaggaaggagaaucacuugaaccugggagguggagguugcagugagucaagaucaugccacuguacuccagccugggugacagagugagacucaguccaaaaaaaaaaaaguacugaauagaauuugaucaugcugcuagauuuaaaugacaauuuuuaagaaauucagggauaaaggaagauauuuaauaaacuaugcauaugcaauuagcauauuccaggauauggggcccuauuagaacaaauacucugguuucuucaacaacaaaagguaaggagguggguggcuauagauuaagagacucaaaaggcauaucaaccaaguguaacauauagaaauuaggacaggugcaacagcucaugccuguaaucccgacucuuugggaggccgaggcagaaggaucgcuugagcucugguguuugagaccagccugggcaaccuggugaacccucaucucuacaaaaaaaaauacaaaaauuagcugggcaugguggugcaucccuauagccccagcuacuugggaggcuggagugggaggaucauuugagaccaggaggucaaggcugcagccuggaugacagugagacccugucucaaaaauaauaauaauaauaaauuuuugcaacaaaccuuaaaguguggauaaaauuaagacauucauagaaaaacauaacuuuucaaacucacagaacuaaaaaaugugaaugguccuauaaugauuaaagaaauuaaauauguaauuuaaaacuuuccuauaaagacaguuucaagcccagagggcuuuaccagaaaauucuauuaagcacauaaggaaaaaacaauaaucuuucaaaaauuuuuccagaaaauacaacaauaggauauacuccccaauucauuuuaugaagccaacaaacuuugauaccaaaaccuaacaaguacacuuagagaaagaaaauguucaggccaaucucacucacaaguauagauguaaaaauugcauauaaaauagcagcaaauugauccacuaacacauaaaaugaucaacuacauucccaccaaauuguguuuagaccaagaaugggaaguugauuuaacacacaaauuucaauaauucacauaaaugacaaguugugaggagagaaaaagaaaaauauaucaucccauuauucaccagagaaaugcaaauuaaggucacaauaagauagauacuacuauuagcaagcuaaaauuaaaaaacugacgauaccaagaauugaugagaacauaaagcaacuggaacucucaaauaaggauggaaggugguguaaacugauacaaccaccuuggaaaauucuuugcuauuagucacucgaguugaacacacguauaccuuauggccucacaauucuacuccagaguauauacccaauauaaauguauauauauauauaugcauaccaggacauaugugcaaaacuauucaaggcaacauuacuugguaauagaaaaaaaaccgaaaacagcaaaagaucuagaagagccaaaaaaauacugaaggagcagaacaaaguuggaagacugauacuacccaacuucaagacuuauuaugaagcuacaauaaaucagguggggcacaguggcucaugcuuguaaaaucccggcacuuugggaugcagaggugggcagaucauuugagcacaggaguuugagaccagucuaggcaacauggugaaaccuugucucuccaaaaaaaaaaaaaaaaaaaaaaguauugucacuuugaaagacacugggcauggugccacauauguauagucccaacuauucaguaggcugaggcagaagaauugauugagcccaagacguggaggcugcacugcacuccagccugagugacagaacaagacacugucucaaaaaaaauaaauaaauaaaaauaaaaaaauaaagcuaggggagggauagcauuaggagaaauaccuaauguagauauguagaugacagguugauggguguagcaaaccaccacggcacauguauaccuauggaacaaaccugcacauucugcacauguaucccggaacuuaaaaguauuuuaaaaaggccgggcaugguggcucacaccuguaaucccagcacuuugggaggcugaggcuggccgaucaccugaggucaagagaucgagaccauccuggauaacaugaugaaaccccgucucuacuaaaaauacaaaaauuagccgggugugguggcgggugccuguagucccagcuacucgggaggcugaggcaggaaaauggcaugaacccgggaagcggagcuugcggugagcagagaucgcgccacugcacuccagccucggcgacagagagauacucugucugaaaaaaaaaaggaacaaaugcaauacgauggaacaaagauaguauuuucaauaaaugguacuggaacaacuggacaccuauaugcaaaaaaaaaaaaaaaaaaaaugaauccagacacagaccuuacacccuucacaaaaauuaacucaaaauguauuacagaccuaaauguaaaacauaaaacuacaaaaccccuagaagauaacauaggagaaaaccuagacaacauuggguauggugacgacuuuuuagaacaguaucuaaacgcauuccaauaucuaaaggcacuccaauacaccagaccuuggcuauggugaugacuuuuuagacacaauaucuaaaggcauuccaauaccuaaagguauuccaaacccaaaauccauaaaauaaauaauggauauguuggacuuucuuaaaauuaaauacuuuuguucuuugaaagacaaauucaaaagaaugagaaaacaaaucagacugugagaaaauauuugcaaaugacacaucugauaaaagaccauuauccaaaauauauaaagaacucuuaaaacccaauaagggggcagcuggcaagauggcugaauaggaacagcuccagucugcagcucccagugagaucaaugcagaaggcaggugauuucagcauuucuaacugagguacccggcucaucucacuggggcuaguuagacagugggugcagcccacagagagcgagcagaagcaggacggggcaucacccuauccaggaagcacaaggggucaggaacucucuccccuagccaagggaaggcaugagggacugugcugugaggaauggugcauuccagcccagauacuacgcuuuucccacagucuuugcaacccgcagaccaggagauucccucgggugccuacaccaccagggcccuggguuucaagcacaaaggaccacaacuccucaccagcaagagaacaaaacuggauggagaaugaguuugacaaacugacagaaguaggcuucagaagguggguaauaacaaacuccccuaagcuaaaggagcauguucuaaccaaaugcaaggaagcuaaguaccuugaaaaaagguuagacgaauugcuaacuagaauaaccaguuuagagaagaacauagaugaccugauggagaugaaaaacacagcaugagaacuuugugaagcauacacaaguaucaauagccaaaucgaucaaguggaagaaaggauaucauagacugaagaucaacuuaaugaaauaaagcaugaagacaagaauuagagaaaaaagaaugaaaaggaacaaacaaagccuccaagaaauaugggacuaugugaaaccacgaaaccuacauuugauugguguaccugaaagugauggggagaauggaaccaaguuggaaaacacucuucaggauaucauccaggagaacuuccccaaccuagcaagacaggccaacauucaaauucaggaaauauagagaacaccacaaagauacuccucgagaagagcaaccccaagacacguaauugucagauucaccaagguugaaaugaaggaaaaaauguuaagggcagccagagagaaaggucggguuacccacaaagggaagccuaucagacuaacaguggauaucucugcagaaacccuacaagccagaagacagugggggccaauuuucaacauucuuaaagagaagacuuuucaacccagaauuucaugucuagccaaacaaagcuucauaaacaaaggagaaauaaaauccuuuacagacaagcaaaugcugagagauuucaucaccaccaggccagucuuacaagagcuccugaaggaaacacuaaacauggaaagaaacaaccaacaccagcaacugcaaaaacauaccaaauuguaaagaccaccgacauuaugaagaaacuguaccaacuaaugggcaaaauaaccagcuagcaucauaaugacaggagcaaauucacacauaacaauauuaaccuuaaauguaaacaggcuaaaugccccaauuaaaagacaaagacucgcaaauuggaugaagagucaagacucacuggugugcuguauucaggacacccaucucacaugcaaagacacacauaagcacaaaauaaagggauggaggaauauuuaccaagcaaauggaaagcaaaaaaaagcagggguugcaauccuagucuucgauaaaacagacuuuaaaucaagaaagaucaaaagagacaaaggccauuacauaacaguaaagguaucaaugcaucaagaugagcuaacuauccuaaauauauaugcaccuaauacaggagcacccagauucauaaagcaaguucuuugagaccuacaaaaagaauuagacucccacacaauaauagugggagacuuuaacaccccgcugucaauauuagacagguaaacaagagagaaaauuaacaaagauauucaggaauugaacucagcucuggaccaagcagaccuaauagacaucuacagaacccuccccgcaaaaucaacagaauauacauucuucucagcaccacaucacacuuauucuaaaacugaccacauaauuggaaguaaaacacuccucagcaaaugcaaaagaacggaaaucauaacaaacagucucucagaccacagugcaaccaaauuagaacucaggaauaagaaacucacugaaaacugcacaacuacacggaaacugaacaaccugcuccugaaugacuacuggguacauaacgaaaugaaggcagaaauaaguaaguucuuugaaaccaaugagaacaaagacacaacauaccaggaucucugggacacagcugaaacaguguuuagagggaaauuuauagcacuaaaugcccacaagagaaagcaggaaagaucuaaaauugacacccuaacaucacaauuaaaagaacuagagaagcaagagcaaacaaauucaaaagcuagcagaagacaagaaauaacuaagaucagagcagaacugaaggagauagagacaugaaacagcguucaaaaaaaucaaugaauccaggagcugguuuuuugaaaagaucaacaaaauagauagaccgcuagccagaauaacaaacaagaaaagagagaagaaucaaauagacacaauaaaaaaugauaaaggggauaucaccacugauccaauagaauuacaaacuaccaucagagaauacuagaaacaccacuaugcaaauaaacuagaaaaucuauuagaaauugauaaauucggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaaaaaaaaaagaaauugauaaauuccuggacacauacacauacacccucccaggucuaaaccaggaagagguagaaucccuggacagaucgauaacaagcucugaaauugaggcaguaauuaauagccuaccaaccaaaaacagcucaggacaagacggauucacagccaaaaucuaccagagguacaaagaggagcugguaccauucauucugaaacuauuccaaacaauagaaaaagagggacuccucccuaacucauuuuaugaggccagcaucauccuaauaucaaaaccuggcaaagacacacacacacaaaagaaaauuucaggccaauaucucugaugaacaucagugcgaaaauccucaauaaaauacaggcaaaccgaauccagcaacacaucaaaaagcuuauccaccacuaucaacucagcuucaucccugggaugcaaggcugguucaacauacgcaaaucaauaaauguaauccaucacauaaacagaaucaaugacaaaaaccacaugauuaucucaauacaugcagaaaaggccuucaacaaaauucagcaccacuucacgcaaaaaacgcucaauaaacuagguauugguggaauguaucucaaaacaauaagagcuauuuaugacaaacccacagccaauaucauacugaaugggcaauaacuggaagcauucccuuugaaauccaucacaaaacaaggaugcccucucucaccacucuuauucaacauaguauuggaaguucuagccagggcaaucaggaaagagaaaaaaauaaaggguauucaaauaggaaaaggggaugucaaauugucucuguuugaagaugacaugauuguauauuuagaaaaccccaucgucucagcccaaaaucuccuuaagcugguaagcaacuucaguaaauucucaggauacaaaaucaaugugcaaaaaucacaagcauuccuauacaccaauaauagacaaacagagagcuaaaucaugagugaacucccauucacaauugccacaaaaagaauaaaauaccuagaaauacaacuuacaagagaugugaagaaccucuucaaggagaacuaugaaccacugcuaaaggaaauaauagaggacacaaacaaauggaaaaacauuccaugcucaugcauaggaagaaucauauugugaaaauggccauacugcccaaaguaauuuauagauucaaugcuauccucaucaagcaaucauugacuuucuucacagaauuagaaaaaacuacuuugaauuucauauggaaccaaaaaacagccuguauagccaagacaauccuaggcaaaaagaacaaagcuggaggcaucacuucaaacuacacuacaaugcuucaguaaccaaaacagcaugguacugguaccaaaacagagauauagaccaauggaacagaagagaguccucaaaaauaacaccacaaaucuacaaccaucugaucuucgacaaaccugacaaaaacaagcaaugggaaaagauucccuauuuaauaaaugguguugggaaaacuggcuaaccauaugcagaaaacugaaacuggaccccuuccuuacaccuuauacaaaaaauuaacucaagaugggcuaaacacuucaacguaagaccuaaaaccauaaaaacccuagaagaaaaccuaagcaauuccauucagaacauaggcauaggcaaagacuucaugacuaaaacaccacaagcaauggcaacaaaagccagaauuaacaaaugggaucuaauuaaacuaaagagcuucugcacagcaaaagaaacuaucaucagagugaacaggcaaccuacagaaugggagaaaauuuuuacaaccuauccaucugacaaagggcuaauauccagaauccacaaagaacuuaaauuuacaagaaaaaaacaaccccaucaaaaagugggcaaaguauaugaacagacacuucucaaaagaagacauuuaugcagccaacgaacauaagagaaaaugcucaucaucacuggucauuagagaaaugcaaaucaaaaccacaaugagauaccaucucaugacagucagaaugcccaucauuaaaaagucaggaaacaacagaugcuggagagaauguggagaaacaggaaugcuuuuacacugcuggugggaguguaaauuaguucaaccauuguggaagacaguguggcaauuccucaaggaucuagaaccagaaauaucauuugacccagcaaucccauuacuggcuauauacccaaaggauuauaaaucauucuacuauaaagacacaugcacacauauguuuauugcagcacuguucacaauagcaaagacuuggaaccaacccaaaugcacaucaaucacagacuggauaaagaaaauguggcacauauacaccauggaaucuacgcagccauaaaaaagcaugaguucauguccuuugcagggauaugguugaagcuggaaaguaucauucucagcaaacacaagaacagaaaaccaaacaccacauguccucacucauuagugggaguuaaacaaugagaacacauggacacagggaggggaacaucacacaccagggccuguuuggggguugggggcuggggggcugggggagggauagcauuaggagaaagaccuaauguggaugacagguucaugggugcagcaaaccaccauggcacauguauaccuauguaacaacccugcacguucgcaccuauaucccagggcuuaaaguauaauaaaaaaauuuuaaaaaaaauaguaagaacacaaacaaccauauuaaaaacaaaaaugagccaaagaccuuaacagauaccucacuaaagaagauacacagcuggcaaauaagcauaugaaaagauggaggaaaggugugcugguucccuccuguaaucgcagagcuuugggagacuguggcgggaggacugcuugagaccaggaguucaagaccagccugggcaacaugcugagaccacaucuugacaacaacaaaaaagccaggugcaguggcucacaccuauaaucucagcacuuugcaaggcugggcaaggaggaucacuugaggccaggaguucgagacuagccugggaaacauagcaagaccuugccucuacaaaaaaaaauuaaaagcaaagaugcuccacaucauaugucaucaggaaaaugcuaauuaaaacaaugauaagauaccacuauauacuuauuggaacagccaaaaucuagaauacugaccacuccaaaugcuggcaaggauguggggcaauaagaacucuaauucauugcuaguuaaaaugcaaaaugguauugucacuuuggaagauggguuucuuacaaaauuaaacauauucuuuccauauaaucaaguaacugcguuccuugguauuuaaauuuuaauuaauuaaauuaaaacuuauguucacacgaaaaccugcacacagauguuuacugcagcuguauucauaauugccaaaacuuggaagcaaccaagaugucccugaguaagucaguggauaaaauguaguacauccagacaacaaaauauuauucagcacuaaaaugaaaugagccuggccaggcacaguggcucaugccuguaaucccaacacacugggaggccgagauggguggaucaccugaggucaggaguuccagaccagccuggcugacauggcaaaaccccgucucuauaaaaaauacaaaaauuagccaggcaugguggugcaugccuguggucccagcuacucaagaggcugaggcacaagaauugcuugaacuuaggacagggagguugcaguuagccaugaucgcaccucugcacuccagccugggcuggguaacagagcgagacucugucucaaaaaaaaaagaauaauacaaaaaucagccgaacaugauggcgcagggcuauaaucccagcuacuugggaggcugaggcacaagaaucgcuugaauccagggggcagaaguuacagugagcauugacugagccacugcacuccagccugggugacagagcuagacccugucucaaaucaaucaaucaaucaaucagauaauguauacaaaguuuacguuuuuuccuuucucauuggguccuucaagaaauaugauuauccuauuguuccaggcuuugugcuagccacugggauacaaacaaauacuguuucacagaggaacauaaaaacaaauaaaaauaaauaauuaccaaauuuuauaaauacuacaaagagauaggugauguaacaaaagauuauauuagguguuuuugaccuagucagagagauuaggaaaggcauccuuagagcagugaccacuuugcugagcucuaaagaauaaguaggcauucaauauucaacauucuuaaagaaaagaauuuucaaccccgaauuucauauccagucaaacuaagcuucauaagugaaggagaaauaaaauacuuuacagacaagcaaaugcugagagauuuugucaccagcaggccugcccuacaagagcucccgaaggaagcgcuaaacauggaaaggaacaaccaguaccagccgcugcaaaaucaugccaaaauguaaagaccaucaagacuaggaagaaacugcaucaacuaacgagcaaaaucaccagcuaacaucauaaugacaggaucaaauucacacauaacaacauuaacuuuaaauguaaauggacuaaaugcuccaauuaaaagacacagacuggcaaacucgauaaagagucaagacccaucagugugcuguauucaggaaacccaucucacaugcagagacacacauaggcucaaaauaaagggauggaggaagaucuaccaagcaaauggaaaacaaaaaaaggcagggguugcaaucuuagucucugauaaaacagacuuuaaaccaacaaagaucaaaagagacaaagaaggccauuacauaauaguaaagggaucaauucaacaagaagaguuaacuauccuaaauauauaugcacccaauacaggagcacccagauucauaaagcaaguccugagugaccuacaaagagacuuagacucccacacauuaauaaugggagacuuuaacaccccacugucaacauuagaaagaucaacgagacagaaagucaacaaggauacccaggaauugaacucagcucugcaccaaguggaccuaauagacaucuacagaacucuccaccccaaaucaacagaauauacauuuuuuucagcaccacaccacaccuauuccaaaacugaccacauacuuggaaguaaagcucuccucagcaaauguaaaagaacagaaauuauaacaaacuaucucucagaccacagugcaaucaaacuagaacucaggauuaagaaucucacucaaaaccgcucaacuacauagaaacugaacaaccugcuccugaaugacuacuggguacauaacgaaaugaaggcagaaauaaagauguucuuugaaaccaacgagaacaaagacacaacauaccagaaucucugggacgcauucaaagcaguguguagagggaaauuuauagcacuacaugcccacaagagaaagcaggaaagauccaaaauugacacccuaacaucacaauuaaaagaacuagaaaagcaagagcaaacacauucgaaagcuagcagaaggcaagaaauaacuaaaaucagagcagaacugaaggaaauagagacacaaaaaacccuucaaaaaauuaaugaauccaggagcugguuuuuugaaaggaucaacaaaauugauagaccacuagcaagacuaauaaagaaaaaaagagagaagaaucaaauagacgcaauaaaaaaugauaaaggggauaucaccaccgaucccacagaaauacaaacuaccaucagagaauacuaccaacaccucuacgcaaauaaacuagaaaaucuagaagaaauggauaaauuccucaacacauacacucucccaagacuaaaccaggaagaaguugaaucucugaauagaccaauaacaggaucugaaauuguggcaauauucaauagcuuaccaaccaaaaagaguacaggaccagauggauucacagccaaauucuaccagagguacaaggaggaacugguaccauuccuucugaaacuauuccaaucaauagaaaaagagggaauccucccuaacucauuuuaugaggccagcaucauccugauaccaaagcugggcagagacacaaccaaaaaagagaauuuuagaccaauagccuugaugaacauugaugcaaaaauccucaauaaaauacuggcaaaccgaauccagcaacacaucaaaaagcuuauccaccaugaucaagugggcuucaucccugggaugcaaggcugguucaauauacgcaaaucaauaaauguaauccagcauauaaacagaacaaaagacaaaaaccacaugauuaucucaauacaugcagaaaaggccuuugacaaaauucaacagcccuucaugcuaaaaacucucaauaaauuaggcauugaugggacguauuucaaaauaauaagagcuaucuaugacaaacccacagccaauaucauacugaaugggcaaaaacuggaagcauucccuuugaaaacuggcacaagacagggaugcccucucucaccacuccuagucaacauaguguuggaaguucuagccagggcaauuaggcaggagaaggaaauaaagggcauucaacuaggaaaagaggaagucaaauuguccuuguuugcagauggcaugauuguauaucuagaaaaccccauugucucagcccaaaaucuccucaagcugauaagcaacuucagcaaagucucaggauacaaaaucaauguacaaaaaucacaagcauucuuauacaccaacaacagacaaacagagagccaaaucaugagugaacucccacucacaauugcuucaaagagaauaagauaccuaggaauccaacuuacaagggaugggaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuacuaaugacuuucuucacagaauuggaaaaaacuacuuuaaaguucauauggaaccaaaaaagagcccgcaucgccaagucaauccuaagccaaaagaacaaagguggaggcaucacacuaccugacuucaaacuauacuacaaggcuacaguaaccaaaacagcaugguacugcuaccaaaacagagauauagaucaauggaacagaacagagcccucagaaauaaugccacauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucacgauggauuaaagacuuaaauguucgaccuaaaaccauaaaaacccuagaagaaaaccuaggcauuacuauucaggacauaggcaugggcaaggacuucaugucuaaaacaccaaaagcaauggcaacaaaagccaaaauugacaaaugggacuaauuaaacucaagagcuucugcacagcaaaagaaacuaccauuagagugaacaggcaaccuacaaaaugggagaaaauuuucacaaccuacucaucugacaaagggcuaauauccagaaucuacaaugaacucaaacaaauuuacaagaaaaaaacaaacaaccccauccaaaagugggcgaaggacaugaacagauacuucucaaaagaagacauuuaugcagccaaaaaacacaugaaaaaaugcucaccaucgcuggccaucagauaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccacuguggaagucaguguggcgauuccucagggaucuagaacuagaaauaccauuugacccagccaucccauuacuggguauauacccaaaggacuauaaaucaugcugcuauaaagacacaugcauauguauguuuauugcggcauuauucacaauagcaaagacuuggaaccaacccaaauguccaacaaucauagacuggauuaagaaaauguggcacauauacaccauggaauacuaugcagccauaaaaaaugaugaguucauguccuuuguagggacauggaugaaacuggaaaucaucauucucaguaaacuaucacaagaacaaaaaaccaaacaccgcauauucucacucauaggugggaauugaacaaugagaacacauggacacaggaaggggaacaucacacucuggggacuguuguggguugcggggaggggagagggauagcauugggagauauaccuaaugcuagaugacgaguuagugggugcagcgcaccagcacggcacauguauacauauguaacuaaccugcacauugugcacguguacccuaaaacuuaaaguauaauaauaaaaaauaaaaaauaaaaaaaaagaaaaagaaagaaaaauaaaaagaaaugcugcauuauugaugaucuugaugguccagagacugauacccugugaaaaagauaggauuuugacauguaauucagagggauaaaauauaaauguggagucauuuuaggaauauuuuaaccaacuuauugaauuuauauuuuacuucuuuugaauggaaauuaaaguucuaaauaaaaaaaaaaaagaauaaguaggcauuaacuaggugaagagaagaauaaguauuuacaaagccuggacuagacagaggaagccugucuauaagauacccaguaucucuggaguggaaagaauaaggagcagccuguaauucauguaucucuuuguacuauguaugcaguuuuguuauuacucauuuuuguuaauuguuucuauguucuccugugagacaauauucuguuguaucccaugccuagcauagagccuagaacaauaagaccugaaagguaguuuuagggucagaauaugcaggccuaucuuaagagcaaugggaagcccuugagauggcugaaagagaagagguaacaacugaucuguacuauauuucaaaaaaaccacuccaacuacaguagacagaguaaguugcaggaaaacaagaacaacuguagauagagcaguuacgagcuacugcugaaguucaggcaaaaauaaugauagcugggaucagcauaaugaaguuacagauucauucuauggaaaaaccuuuacugagggccuaccaagugacaagcacuaucacaagugcauaaauagagcaaaaagacaaaauaagcaaaaaaagacaaaaaucccugcccuuguuggguuuauauucuagugggaagagacagaaaaauaaauaaaugaaauaucacuuuuaucagacaguuauacauacuauggagaaaaauaaaguaguaaaggggaaguaugacggauugucucacuacccaaagaaucagaaagggauagauucugggcaaaggaaggauaacccaggaguccuggacuucuuaaggugacuaacauaaacagggcucaaaggcauaauaucugcccugaugguugcaaaguagacagugauaguagugaaguguaggggaagagggaaggcuaaggaacaugccaagagaugcagaguucugcggccuuuccuuugcuccugccaaugauaauguagaagcccggaggaaggagagccuuacccagagcacuugagcuuuugcauuccuuguugauuccaguagagaggagggaguaagaaaagaaccgaacuuauagaauaguuuauuccccaauuccuaucagucuguaaacuccaugaagggagaagcuguuaucuuaaccacuauauucccauaauccagacaaguagcugguacacagcacugaugggauauacauuguugaaagaauacaugaauaaauggaguauuaaauuuaaagccaaaguaucccuauauuaucaagguaaagauuuuaaauguguucauauaaauaauuacaaaguugggguagccacaaaauagcuuuaaguuaguaggauagcagcuuuugaguuguuugauuuugaaucauaaucaaauuauauuuauucuuaauagcuuuuaaauucgcuauauucuaagagucuuaacaacaaucacauuuuauaaauuugcaagauuuuaaaauauauacuuaggacuuuuaaaaauaaaaguuacaaaaacacaaaauuaaacugaaguucagaaaaguuagucuuuucuaauuauuuuagcaugguuaacaaauguuaauguuuuauccuacaaacuucucaacuguauuauaucaccuugcuagcauauccagugaaaaauauguagauaauauuuucaagaaggaauccacaaaccagggguauuaaacuuugagccacuuugagccacuauacagcccucagcuguguagaugauagauacaaauagauagauauaauuacaguacauauuuuaaaacaauuacuuuauuccaaauccaaauaaaguuuucuccauuauuuauauucuaaaauuuaaauugcuauuaaguuguuaaacaaauuacuuauuuaaaaaauacauaccguucccuuacaaaaucugcuaguucuuuuguugauaucuguccauguuucauauuaugguagaggacaucaaagccacuauuuuuuucccccuaaaauuuaaaaagauuuuuaguuucauaaaaaaacagauaaaaaugacuugagaauauaaaaagccaacauuaacuaauaugcaauccugugcucaggugagguguuuucauaaauuuuucucauuuauuguaugauuuuaaacaguauaaagcaauauuauaugcuuuaauaaaguuuacaauuaacuauauauacauauaccuacauacaaacauauaugcauacacuuuguaaucacccauaaagguacaauuaauaaaauuaaguugugaccgggugugguggcucacaccuguaaucccagcacuuugggaggccgaggugggcggaucacgaggucaggaggucgagacuauccuggcuaacauggugaaaccccgucucuacuuaaaauacaaaaaauuagccgggcgugguggugggcaccuguagucccagcuacuugggaggccgaggcaggagaacggcgugaacccgggaggcagagcuugcagugagccgggauugugccacugcgccccagccugggugacagagcaagacuccaucucaaaaaaaaaaaaauuaaguaugaggccaggcgugguggcucacgccuguaaucccagcauuuugggaggcggaggcaggcggaucacuugaggucaggaguucuagaucagccuggccaacauggugaaaccccaucucagcuaaaaauacaaaaauuagccgggcaugguggcaugcacccauaaucccagcuacuugggagggugaaacaggagaaucgcuugaacccgggagguggagguugcagugagcugaaaucacaccacugcacuccagccugggagacagggugagacucuggcaaaaacaacaacaaaaaauuaaguaugaaauuuuaaggaauaugcagcauaauuaagaaaagauaaacauggaccuuucaaaacauauuaccaaaucccauuucaaucucuuuaacacacaguaagaaauuccugauuauuuaauuuggaguuugugcuuuaaaauaacuaaaucuugauuucugaguuaagacaguaaaguacuuaagucacaucagcauugaguaucacaaaauacuuagaucuuucaguaaacuuaaccugagaagggagaaaauagacaaaauuuaacaaaagagaagaggcuaugugcuagucuuuaauuaaugggauuuucguuuguuuguuuuuguuuuugagacagucucacucuaucauccaggcuggagugcagacgugcaauuauggcucacugcuaccuccccauccggguucaagcgauucuugugcuucagcccccugaguagcugggauuacaggugugcaccaccacaucuggcuaauuuuuguauuuuuagaagagacaggguuuugccauguuggccaggcaggucucgaacuccuggccucaaacgauacaccugccuuggcuucccaaugugcugggauuacaggugugagcuacuaugcccagccuaauuaaugagauauuaauagaacuagaucacuacacaauccuggaaaaccucuacuguuguuuaauccuaugaauccuuaauuaguaaaucauaaagauaacauuagaaaugucaauuuauucgaugaaauaaaagacagcugauacacuagguuuaacaacucucuuuacaggcagcaguuuuuauucuucuuuagugaaaauggaaaaauggaauauauuuguuggaaaguguuauaccauaagcaaguguuacauaauacaaaacuugauuuuuccacaguccacugaaaacagaaagcauaaaaacuuccagcuauguugaagugauuccugauaaacucaucagcuaauguagcuaguaauuacuuugccuacauaucacaaauuaaaaugucacaucuguaacaagauaauaugaacaauauccuuagcauuuugaauaaccauuuccauuuauuaagaagaauauaacauaaaaccacagccucuugugaauccaaacauuuccauuuggcuucugcaacuuuacauguuuaagauuuuuuuaaaaauuuauugucagaggcuugugccuguaaucccagcuacuccagaggcugagcaaggaggcuugcuugaugccagguguucaagaccagccuggccaaagugagaaccugucucuaaaaaaacaaaaagauaaggguuugaaacuucuccuucggugaacuuuuuaagaguaacaguaaauuagacacuaaaaauaaaaaaccuggauagcauucaguuuuuuaaaaaaaguuuauguagaaacagggucucgcuauguugcucaagccagucucccaacuccuagccucaagcaauccucccaccuuggccucccaaagugcugggauuacaggugugagccacugcauguggcgagcauucacuuuuggugaguccaagauuugaaaaauaggcagaagauagauuguauauuguauaaucacauuacugauuaaaaaauugguuuuaccaaguuuccuuuuuuucaaaaaguucuuuggagggguaagagaagggucaggagguacuauccugcaaacaccaauaacaugccuaaccucccucucaacucuaaaccaccucaaaaauaaauaaauacuauaacuucccacccugucuacauuuuccuuuuaauuuagcucuuauggacauuuaauagacaacccuggacaagucaaugcacaauauaacauucauauuuuugauacagucucacuuuaucuugacuucucugaaacacaccaaaaaacauuuuacuaauccuaaagauuuuuuucuuugaagaacagccccuuuagugaagaaccuacagauacgcuuugaugagaacucaauagacaugcaaugacagcucuccagugccacucuggccuugaaaacugcuagggagcuggagguaaaauacaggcacacuucauuuuacuguacuuucuuuuauugagcauugcuuuacugcacuuugaaaauacugcauuuuuacaaauugaagguuuguggcaaucgugucaagcaagucuaucaguaucuuuuuuccaacugcaugugcucacuucuucccuguuagcauuagcaauaaaguauuuuuuaauuaagguauauacauuuuuagauaaaaugcuauugcacauuuaauacaccaguauaguguaaauaauauaguguaaacauaacuuuuauaugcacugaaaaaccaggaguuugugacuugcuucacugugguuguuugaauucaauacacaauaucucuaagguaugccuuuguaugcaagcaauuuuucuacagguauacgggacguucaaccacaaguuacaaccucuucucaucaauacucuuauuuguacaguaguccccucuucuccacaggggauauguuucaaaacccccaguggaugccugaaaccauggauagucacgaacccuuuauauacuggucaugaacccuuuauacacuguuuuuuuuuuuuaaucugauaaccaagauggcugcuaagugauuaaugggcaggaaggguauauacuauggaugcacuggacaaagggaugauucgcauaccaaacaggacacagugagauuucaaugcuuaugaauuauuucuggaauuuuccauuuaauauuuucagacugcaguugaccucagaucugaaacuguggaaagugaaauuauggauggggagacaaccguacauugacauuuuuagucaugaucauuaaaaguacucugcagagcuacuggcaagagauacugcuaauggagaaaauagugacuaaaauauauagaaugcucaggcgcgguagcucacaccuguaaucccagcacuuugggaggccaagguggguggaucaccugaggucaggaguuugagaccagccuggccaacauggugaaaccccgucccuacuaaaaauauuuuacaaauuugccaggugugguggcgugccccuguaaucccagcuauauugggaggcugagccaggagaaucacuugaacccgggaggcagagguugcagagcugagaucaugccacugcacuccagccugagcaauacagcgaaacucagucucuaaauaaauaaaaaugaaauaaaguauguagaauaggcagucagaacgauuugaugcagguacaaaagugacucaaacauauuuguugguugauugaaggaaagaaaucuuacuaccuuucaaaaaauuguuuuucucaccucucagauauucuucccuaaucuuuuauauuauaguucaccucugccaguuaguugaauccuuaaagcuaucuaaauaaauauuauauggguugagaaaaaacuacagaagcaaacaguaguuaauuuuuuaauuuuuauauauuuugcguuuucuguaauguucuauaaaugaaaguauuuuucauuacuuucaaaauaaaaaaacuaaaccaacaauuucaguuuucucagcucuucaaucuaugccuacaaagagacagaaggcuacuuucuuaaacuggcaucuuguucacaucaguacuuaaaucuccaguccuuguaauucauaaacaaaaaaaaaaaaaaaaaaaaaaaaaaacugaaaguucccauacaaaaugggaaugauuaaagaaaauuacagccuaucuggccaggugugguggcucacacuuggaaucccagcacuuugggaggcugaggcaggaggaucccuugaggcuaagaguuugagaccagccuaaauaacauagcaagaccucgucccuacaaauuuuuuuuaaaaauuagcugggugugguggcaugcgccuguaguucuagccacuccaaaggcuaaggcaagaggaucccuggagcccaggaguucaaggcugcagugagcuaugauggugauggggccacugcacuccagccugggcgacagaggaagacccugucuaaaaaaaaaaauuuacagccuauccauuccauggaaaccuauuaaagaauacuuauucacaugagaaaaaugcuugaugguaauaucaacugaaaauaccaagacacacaaccauauaguagaaucuaucuugaauuuuguauuucuaaagaaaauuauaaggguagagggagaggcuauaggcaauuuguguucuguauucuucuguguuuuaccuaucccauaauaaugguuuuaauuaaaaaggaaaaccaugcagacuuguggcuguugcuucaaccaacugaaaacucacuccccuugguuuuaaggcuccaccaccaccacuaauuugcuuuacuuauauuauacuuuccaaucuuuucccuaaagucaagcaaacgugcuugauauaucuuccauaaucuucacuccuucaaauacaucagggagcaugacuaucuccucaacuuuaucacacacuguaacacuuuccaguuuaauuaucucugacucuggccauuccagcaacauccucuugcacauuuaucaauauaguagauaucauuacaggucucaguugcugucaugcuguuguuuuuguuucuccccacaucacaacaauuuauacuuaucuuuuuggaccagauugcuacuaaaauucuuccaauucuaauacuuuuuuuuuuuugagacagagucuugcucugucgcccaacuggaguacaguggcgugaucucggcucacuacaaccucugccacccggguucaagcaauccuccugccucagccuccugaguagcugggacuacagguucgcaccaucacgcccagcuaauuuuuguauuuuuaguagagacgggguuucaccauguuggcuaggauggucuugaucucuugaccucaugguccgcccaccucagcuucccaaagugcugggauuacaggcgugagccacugcaccugccccaacucuaauauucuuuaauuuuuccacacuaagaaaacugaaacccaaguccuuauucccuuccuuuuuaaguuuccaugggauccuauuuccauuugaauuucuaagggugcuuccguuaacuauucuagaauuaugacaucaggauggauaaucucaggagauaccucagugacucaaaaaacuacuuucaaagggcuuauauuagccacaugugcaggaugauuuaaagcauaacuguucccucauccuuugcuuaaauaauuuaaguaguucugaaaggacuacagcauuuaggauuuaguguguagagcuaaaaaagaacgcagacaucaaauuuauauccuuucaaaugucaaaguucuaaaauccucccccugaacugaacauauauacacacuaaaucaguaccaauuuucacuuccaaauuucuccuauaauuaagguuaaaaaauaaaacaaaucacaccccuuaaaaaauucuaagggccucucaaauuuuagugcaaucuaaaacacuauaauuuuauaaugucuacugucaagucuucugcaucaaguuaaaugaaucuguagucuucauuuucacagcuuguugcaaugggaacaaguugggccuggcuaacuugcuaaaaguuauacaauaauaauuuuaaccuaguggaguguauguuauuuggucucaucuguggaaaaccauauaagaaauugguaauggugaagccgggcaugguggcucaugccuguaaucccagcacuuugggaggccgaggcaggcggaucaccugaggucaggaguucgagaccagccucaacauggagaauccccaucucuacuaaaaauacaaaauuagccaggcaugguggugcaugccgguaaucccagcuaccagggaggcuaaggcaggagaauugcuugaaccugggaggcagagguugcagcgagcugagaucgcgccauugcacuccagccugggcaacaagagcgaaacuccgucucaaaaaaaaaaaagaaagaaauugguaauggugauugccuuuagggacaucuugauuaccagagaaaaagaagauuuacucccucuuauaccuuuuaaauauuaaaccauguaaaauuugcaaaucucuuaauguauaaaguaaauauauacagauauauagauuuuguuuugguaugucaucugaugggaucauauccuaaaaacagguaucccaaacuacaauauuuggaaauuucaaguaaugaaaagccuuuauucuggguuucaaauauggucaccuaaacuaauuugcuaaagauauauauuuuaaaauuucauauggauacauaaccccaaagaauguguguuagucucucaucuaggauacuaaguuuagauuaaucaagcaaaaauauaauaauguuuuuuaucccaaagaccuauuaauagcaauuccagaauuuuaaaauacauuuuaauucucuuagcuuauccaaguaaugauaaaucaaauuuuggguauauaaccaauguuucaauuuaauuuuaaaucaaaauguaacaaaaccaauaaaaucaagugaaaugagacuucuguacaguuaaucaguaaaagaaauaaggaaaaacuucaggauaaaaauaccuaauuguuguuuguucauuuuuuaugugcugacuauagauaaccucuggaaaaagucaccuaacuaaaaaucucagcucauuacaaugugauauauacuaaagaauacuacuuagugucuuugggugaaugcuucauaucguauauagauugggauuacucuguaaaaugaagauuauaagcuauucaacucagguauguuuuacauacuuauuugucccccauuaauaauuaccuaugaaaugcauuaagguuuuuuugcugaauaaucuggguuuacauaaaaauauaaugccauuuuaauuauuacauagcaauguuguuauaaucucaagacuauuauaaacuuguacucaauuauuccuuugagaaagcagcggcuuagacacuuccucacuguaauacugaucaauaucuuuuuaaaguuacauaaucuuuuauaauaucuuuuuaaaguuacauaauguuuaauauguaaaaauaaagauaaaaaacaauuguuuuuacauauuaaaagcaauggugugaauuucuacuaguaaaauuauuuuugcguccaauuuuaauuuugcuguccaauuucagcuugauuaucaauggugcuauacuucguggcaaaaacugacuuaucaauaacaaaacaccuguucuguaaaagguuuugaauaauuuuuccuucaaaguacaguauuaaguaaaggaauuuucaauuuagcauauaguuucaauugagaaaaccuauacuuuaaagaaaaaggaagaaugugcugcuuucaaaagagcuugaagagaguuucaacgauucaaacuuucuucuaaugaaaugucacaacaaaaaagguuugucuuuauacauguaggggagaaaacaauuaauagguuguuugauuagaaaccuaaaacuuuggcugggcacaguggcucagccuuuuaaucccagcacuuugggaagcugaggcggaaacauggcuugagcccaggaguucgagaccagccugggcaacauagcgagaucucaucuccacaaauaauuuaaaaaccagcuggucaugguggccuguaccuguggucgcaccuacuuggaaggcugaggugggaggaucauuugagcuugggugguugaagcugcagcgagccaugcucgugccacugcgugccagcccaggcaacacggugagacugcaauucagaaaaaaaaaaaaaaaagaaagaagagaagagagagaagagaagacaagacaagacagaccuaaaacaucaaagguucucacuaccucacuuugacaaguuuuuaucuuuuaauugaugaaaaacauauauauuuaucauauagagcacgauguuuugaauuuugacaauuuuauuuccuuuuaauaguuccacuuuaaaugcuagagggaagaguuaaauuaauaucuauuuuaagggauuauuuuauaaaugauccugaaauaugugaauuuuuaguuuucuguuuuugagacagggucucacucuguugcccaggcuggaguacagugaccaaucauaaccuacugcaaccuugaacuccugggcucaagcaauccuccuaccuuagccuuccaaguagcugggacuacaggcauaugccaccacacuuggcuaauuuuuuaaaauuuuuuguagagacaaggucuacuguguugcccaggcuggucuccaauucuugggcucaauccauuccccugccucagccucccaaagugcugggauuacaggagugaaccaccaugcccagccuaaaaugacaacuauaaauucucggaaguuaauuauuuaguuaauuccuagaccuuccuagcucacugagccuccucacagccccaauuccaagccaggaaauaaaauaaaaugcagucuauuaacuauuuguuuucaauagugaaagugaaggcaaaaacuaaaacauaaauuagauuuggaggucucuccagaauucaaauauugaaguuuauucccaucccucuuguaacaagaauacccaagaagcacauaaaaauguguagaaagauauucagagaaguauuauucauauuagccaaaaacaucaaacaaagcuaugcucaaagcucaauuaacagaaaacgaaacauaacuuuuaaugugaagaugcaauuuggaauuaaguuagcaacuuaaaaaacauucaugcaucaaaaauaugcauaacauuuacaagagcaucaauuuuuaaaugcucuuuaaaacauuuuauaaauugccauuguaaaaccuaaugccuaaaauugacaggcuaauccuaaaauucaucuggaaaugcaaggaacccagggcagucaaaauaauccugaaaaagaaggaaaaagcuagaggacucauacuuccugauuccaaauuugcuauacaaaacaaauuuguaauccaaacaacagcaauccaaacuguguguuacuggcugucguaagggaagacaauggaauagaauugaaaauacagaaaugaauccauacauuucuggucgauugauauuugacaaugguaccacaauucaacggggaaagaugaaccuuuucaacaaaugguacugggacaacuggauacacaauugcaaaagaaugaaguuauaccuuucccuugcaccauacacaaaaauuaacuucaaauggaucauagaacuaaacagaagaaguaaaacuauaaaacccuuacaagaaaacaagaaaaaaggcguaauuuuuggguuaggcaaauaauuuuuggguuagaugcaauaaaagcacaaguaauagaaaaaaauagauaagauggacuucaccaagacuucacgagaaauaaaaacuuaugaguuacuucaaagagcagcaucaagaaaaugaaaaggcaggccacagaaugggagaaaauguuugcacauuauguaucagauaagguguguauccagaauauuaaaaaaaaaaaaacucuuacaacucaauuauaaaaaaagacaacccaauuuuuaaaugggcaauuaaucuaaauagacauuucuccaaagaaaauauaaaaauaggcaauaagcacauuaacugugauguuaagcaucaaagaaacgcaaaucgaaccacaauaaaauauuaauacuacuucacguucacucacuauauuauaauaaaaaggacaaauaaguguucgugagcauguggagaggaacccucagauauugcuggugggauuguaaaaugcuacaaccacuucagaauaguauggcaguuccucaaaauguuaaacauagagcuacgauuugacccaggaaucccauucccaaaagaaaugaaaacauauguucacacaaaaacuuguacaaaaauguucaugcagcauuauucauaacccaaaagugggaacaaccagauguccaucacugauuggauaaauauuaauaaaauguggaauggaauauuauuugaccauaaaaaggaauuaguagugauacaugcuacaucauggauaaacuuugagaacauuaugcuaagugaaagaaacuggucaccauggccccauuuauaggauauguccagacuagacaaaugcagagaggcagaaaauacauuaguugccuaggccuggggcagggggaaaauggggagugacugcuaaugggucuagggauucuuucugggauaacgaaauuguuguaaaacugauauggugauguuuacacaacucuaugaacauaugaaaaaaccucugaauuguacuacacuuuaaaugaguguauugguacggaaaugugaacucaauaaagcuguuuaaaaaacaaaacaccuaaggucuaguauauacguucuuuguggaaaacaagguacauucaagacaaauaaauaacuaugaacugaucugauuacuaaccaagaccaugcuugaggcacuuagaauuaagaauuuaacauacauuccuuacuagcuaaaagauuaccccuuuaaauaugucuaaaucucaacgaaaauggaccugcaguacuugcaacugucagggcauaaaaugggauucacgaaagauaccugaguaaacacguuccuuuccuguacauggcugaacuguacuucccauuacaaaaaaaaaaacaauaacugcagaaaaauacuccaccgggagccggagaaauucucaaagaagaaucuaauacugagcuaagacaagggguggaaagaaugaggaaggggaaggagcacagaguagggggaggucuccaugcauuuaagcccaaggaguccaguuacauuaaauccaacuuuuaaacgcuuugugaacaggcccagaggcaaaguccugggcgcaaacccacgagccgagcugcgaggcugagaggaagugcuaguccagcccaaccccgcacuggauuugguguggaaaccgucagagguaaaagggaucgcucagauggggggcccgcggugagggcaggaggcaaaaccccaccgcccggcgcucccagccagcgcgcagcgggaggcggcugugccgcgggcccguccuucgcguccgagcugccgcgcacgccccgcgcggagcgcggcaccgggagccuccgguggggcugggucccgucucccgccccauccggcgcuuugucccagccccgguggccggcggccccgcugcgggcccccgggccgcggugacagcccccguccccauagggcugcgagcccgggagucccuauaggcuggcgaccggucgcccgccggaccucacccaggcgggacgcggcaggaggacgcucgcccugccggaggggccgccgccgccgcccgaagcgcacgcaggccaagcucaggcgccaaaagccuuggacuucgaaacacacgacuuccaacauccuaagcuuacccaaaaauucucgacgaaauacgccaugaccaucgugccgccgccgcgccggguuccgcguccgcgcccgcccgccgcuguguaaacacggcccggcccccacagcacccccgccuuucgccgccgccgccuucuucccagagaccggc

SEQ ID NO: 192455 - RNA, 154467 nt, Homo sapiens
uuuuguuuuuuuuuuuuucggcggagauccucguuggggcugggaaacuccugcaaaacucgagaccaggaagccagcccgcaccccaacccccaccaaagccaccuacucuucuucugugggaggccaguccacauccgcucucacccgagagagauauucagcuggauccaaagugacugaugaagggaaggaaaucaugucaagcgaagccuugaaaaagcugcccugagacggugucccgccgaaagguaauuuucacgaaaagugucucugagucacaaaguucaugggacuuugugacucggaaaagagaugauucuuuaguguuuuucacucuucuccaaguugcccuaaacccuccuuuucucauaucgaagcgguuaauaauugaggggcuaaauaaucgaacugcaccccaccgcgucccuucuccccccugccccccccaccaucuggacuuugaauuuuuuggaagagguuguaagaaugcggugggacgaaaaguuuuuaguaauccgaagaacgauugccuuuguucagcacaggggccagaaguuuuggcuuucuggaacguauagaguguauauuaaguugcucagccaggcaccuucuguuugggaagaaaguuuggucgcugcagugagugauuugcuguuauugagauggcugccgcguuuguuuauacucauaccgauuauauuggcgcuugcguuaauuguauauagagguauuuauuuuuauuuuuuuauuuccaacccugaucaguauauuuaguuagauuuuagaaaccaaaaaaucuugccauucuuaguuguuuuucagggugaguaauauauuucuuuaguuguguguaguguguguuuuucagacguuuagcgccguauaacuuguuuaauuaauugaaagcaaggaucgacuaggcuuuucuuguaacugauccauuacgaagaaaaaaggaguaaggacuaagaauagggagagauaauuaaacaacauuaacaaccuguaagacguuuaauaggacuucuguacaguucagaacagacgaugggaggggaaguaaaacgcuuaaaacgauuuucaagggaaucacagugauugugauaaaaagcugugcuuuucgaguaguauggucuuuacauuuuuguguugucccaaauguuuuuggucgguucugcauaaauagugauagguucugccuacaucugugggggcaggauucaugaagcauggcagacauuccaccagucagagcuaugaacacuucugaaccaauggggacuaguuuugauagcaguaaacccaaaguuuuuuucagugguguuuuagucuuuuucuguuuacuuuuuuucccgguauuuuugcgguacagggaggugaaauacaauacuguacuuuugaauauauauugaauaaauuugguaauccuguugguagguauauccuaaauauauauugauguuuagauugccuaugcugucucacguaaugaccggaaacccgaggagagaguugauuuucuuuaguucaaagagaaaaaauaaguuuuaaagaucaggaucaaauuauuucacaauuuguucuuugcuacuucagcuucauuaaguacaucuccaaaggcaguccuuuauuuauuacuguaguuuugauuuuuuuuuuccuccccggggcauggucucaggagauucuuuuuuuuuuucauuguugguaagauuugugaaccauggaauaauucuuguuaagucaaacuagcuuuaucaaagaauuuaaagugcauaacucaucuacuuuaugauuuuggaacguaucauuaggcugcaaaagagguuauucuugggcaucugaaagaggugaacaaaauaaauggcauugaacuucaguuuccuuauauggcuuauacuuggcuucaaaagcaacaaaaccuuaauagagcaagucccuuacagagaauuaucgcuuuaugaagaugguuauuuauuaguaaauuuuguauaaaaaaaguauuguagcacuugaaaaugacuauuuaagccucuauuuuuagauuuaguucuugauuuuuuuucucaggagaagaguaguauguuucgaugcagacaacacguuuuaugaagugagguguucaccuuuguguuucuuuuuuuucuccucaacaaggcauaauuuacuucguaguuuucuuggaauucuguuaguuuaucaccgaauuaacuuaaauuuuagguuuuauacuauugugaaacuauaaguauuuucgaagcuuuguuuaaacugugacaaagguuugaaaagagguuaauagaggagucauccguuaaaauauuuuuaaauggcuucaaaauuuggauauucuucuaguaugguguggauuuucaaagauuaaauuggcaaauagagaguacuuccaaagucuauauugcacaaaauacacacuuaaaggcucuguuuauugaagguaaucaugaauuuucaggacuucaacugauucaaguaguacuguuacgaggucuccuugccauuugagaucaaacuauuguaaacuuuauguauaaaaagcuuacagagguacaaacauggaaaccaaauuuuuauuguaugcuguuucuuaaugaagugauaacuauagauacauuaacauauaucauuggcaaaucucaaaaaucgauuauuuuacacauuguugguauugcacuauuaguaguaaauaauacccuuuaagaaauaguuaaaaguuucagaaaauagguguauauuucaaaauuacuuauuugaaauaauugcuuacggauaauacgauuuagacuuuaagcugcuuuuguuuuggaaauagauuauggcaguacuuacagaguauuugggauuaugcagaauuuuagugaugcuggguagcaguuucuuuuuuauuuuucguaauugcugcuuauccagauucuccuuacauacccuacuuggcugcuugcauuuugacucuuugccuugcucauucauuucuugaauuuguuacaugcuugcuuccguuuucuuuuucugggaauacaucucuauuauaaaccucuaaagaugucuuugucuuuuccucuuuuuuuuuuuuuuuuuuuucgagauggagucuugcucuguugccuaggcuggagugcaguggcacaaucucgacucaccacaaccuccaccucccggguuccagcgauucuccugcuucagccucccaaguagcugggauuacaagcgcacaucaucaugccuagcuaauuuuuguauuuuuaguagagacagguuuugccauguuggccaggcuggucucgaacucccgaccucaggugaucugcccaccuuggccuaccgaagugcugggauuacaggugugagccacugagcccggccuacugcuaacucccauuuuucagauucacuuuuuagcugucucuucuuagguuuccuaauuguaaaaaagaaacuuagcugcuauucagcuuucucuucugauucccuuagcuuccuauauuuauaguuagcuucauuuaccuagccuuauuuucucuguguucaguuggucguucuuaauuauauuuugccauuucccucuuuuccaaacuguuagucuauguuuaucaccucaaaaaacuguucaaaacaugcaguggaaaaaguuuaucugaucuuauuuuauuagcccauuuaauucugaauauccccuuugcauuucaacuaaguguacaugcugguauuuuaacuuuauauucaucaguauauugcuuuguuuauuuugagauggagucuugcucugucgcccaggcuggagugcaguggcaagauuuuggcccacugcaagcugcgccucccccagguucacgccauucuccugccucagccucccgaguagcugggacuagaggcgcccgccacugugcccggcuaauuuuuuuguauuuuuaguagagacgcgguuucaccguguuagccaggauggucuuuaucuccugaccucgugaucugcccaccucggccucucaaagugcugggauuacaggcaugagccaccgcucccggccauuguuuguuuuauacuuuguuuucucaguuuuccuuuuucucuuuaguguucuuaaaauugacuguuaagauaauaccagguuguuauuuauucuuauguauuaagacuuuguaacccucucuaccuucuuguuuuauuauacuuuuggccucuuaaaacauacagauauauuucucuguuccuucuucucuguaccuuccucuucuguccuaccuuucaaguuagaugucuucucugacacagaaucccuaaaauuuugaaauuaucuuucuuugauuucaugaaauaagcacaauaguacucuaucacucuauuuuugucacuucaaauuuuguuccagacaccauugaaugaaggucuugccaggcuuuaagugauaguguggaagacgauagaaaaggagaauaucuaaaaauucacuuuguggaagacgauagaaaaggagaauaucuaaaaauucacuuaauaagacucuacuuaucuggagguuauuuauuauagcuuuaaaagcauauugaauguaguagaaaaacuagaaaauaaaaaaugacaucuccuuaaucacaacagguaugacagagucuggggacuucacuuuuagggccauuauuauucagagcccauuuacuuauguacauaaugagcuguuuuugguucuuugguaucccagaaggcgugagaaagguacguuuacagcauugugaaguuaugaccugugguguuacagugaagcaauagaaaaauggaaagaugacugaauaacuuagaaaauaaucugggacaacuuacuuugaggcuaagugccuuguacauuucauuucccuguaggaggauucacucuguuauaauaugguauaauuacaagaaauaguaauaguccuaaggcagcuguucucagacuuuuugguuugacucaaaacagaaauuaaaaaaaauuaauuuauuugaaaauaagcuauugcauguuaguguaacauuguuuuaauaaaaauauaauuguuuucuaaaauaaauagcaaaaauaguggcaauguuuuauauuuuugcaagucucuuauguuuggcuuaauagaaaacagcucgauucucauaucugcuucuucacuccaucuguuacaguauguucuuuuggcuaaaguauaugaagaaaauccagccuuauacagguauuugguuggaaaagggaggaagauuuucuuucuuuucuuucuuuuuuuuuuuuuuuuugagauggaguuugcucuuguugcccagacuggagugcaguggugcagucucggcucaccgcagccucugccucccggguuuaagcgauucucuugccucagccuccugaguagcugggauuacaggcaugcgccaccauguccagcuaauuuuguauuuuuuguagagacaggguuucuccacguuggucaggcuggucuugaacuccugaccucaggugaucugcccgccucggccucccaaagugcugggauuacaggcgugagccaccgcgcaaagugcuggucacaaggucaggagaucaagaccauggacaacacagugaaacccugucucuacuaaaauacaaaaaauuagcucgguguggucacaaacgccuguaaucccagcuacucaggaggcugaggcaggagaauugccugaacucgggagguggagguugcagugagccgagaucgcgccacugcauuccagccuggcgacagagcaagacuccgucucaaaaaaaaaaaaaaaaaaagacauaaaccugggaauauguagugguacuauugcagcuugaaggcauugccuuuguucuuguaaagguguuagcuguugcaaccauugcuuuugcaacaucaguguaaaauguaaauauaauggaaaagggaaaaaugacauuucaauauuauaaacacaguuuugaccuggaagguuccuugaaagugucucagggacuuccagagacuguggacuuccagggccuauggacugcacuucaagaacuuagguggaaguugggauuuauggaacuuucauuaauuaaauuuuuuuucuugucuguucguauuggauucugggagaguguugaagcuugaucuuuaagcccacuuacuugauuuucauuuguuuucaguuauuuuguuacuuguuuuuggaacagaguuucuaagaauucuaguuuuucauaggaguuauuuuuguuuuuauuuuuuugagacaggaucucacuguguugcccaggcuggagugcaguggcauacucacggcucacugcagccucggacuccugggcucaagcuauccugucaccucaccuucagccgagacuauaggcaugcaccaccaugcccggcuaauguuuuauuuuuuuuuguagagauggguucuugcucuguuguucaggcuggucuugaacuccuggccucaagcaguccucccuccuuggucucccaaagugcugggauuauggcaugagccgcugcaccuggcccaauuuugguuuucuagcccuauuuuuggucugcauguaaccuuuaaucucugagauguucuuuuaacauugucuuuuguuuauucuacuaacacuacagaaaauuugaucuuacugugcuuuugguguaugucaugcuuuuuguuuuuucuucaaauacuagauuuucaugguagucaaaguuuuauaugaugaccuagucucuacuguauuggucauuuaaauauauguucccagcccaaugaauccuucuucuggcuuuggugauugcuuagaagaggaaagggagaaauauuuaacgaguuucucuuugaagguauguggguagcuugaccuuuugguacaggugcuuacuguuccucaggaggcagucuccuuuuuucauaaucacacuguccaagugucacaucuccuacauacauagagcuguacuagaggcuuuagcuacacaguguuuuacuaugguuuugcucucuggcugaccgcucaggauaugcuucucuuaauccuucuugcuaagaaaacucaucuuuuuuggagaucccacuuucuucuuguuuugggugucugguuccucaaguguauugcauuuuguuauuuccccgaccccagccuacuuuguauucuuuauaaauuccguucuguucuuaucuguagguauaccccucccagguuuucagcacugcuauagauauuuuuaaauuaaauuuuaauuuuugaaacaaugacugacauauggaaaaguuugaacauuuuuuuuccugaaccauuugacuaaguugcuaacaugaugcccugucgucaucccuaaauauauauuuuuuuuuauuugagagcucugucgcccaggcuggagugcaguggcgugaucuuggcucacugcaagcuccaccuccuggauucacgccaguucuccugccucagccucccaaguagcugagacuauagacgcccgccaccacgccuggcuaauuuuuuguauuuuuaguagagaugggguuucaccguguuagccaggguggucuugaucuccugaugucaugauuugccugccuuggccucccaaagugcugggacuacaggcgugagccaccgcgcccagcccgucaccccuaaauauuuuaauguuuauuuccuacaaacaaggauauucuccugcauauaaugacaucauuaccaucaaaaucagaaaguaaacaugaauauauuacuaacaucugaaccucaauuaucccaauaauguguuuuacagcaaacuauuccaguuuggaaucauguguuacauuuuguugucaucucuuuauucuccuucaaucuggaauaauuucuuucucuuuuuuuucaaggccuugacacuuuugaagaucugaagaugacaggccuaguuauucuguagaauaccccucaauuuucauuugugugauauuuuucaugauuagaucuuugauuagauuuuuaugauuagaucuuuggcaggguuauuguaaaagugaugcugcauucuucuuauuacgucuuaucagguggcaggcaauuucaguguguccuauuaugguauucacuuuaugugauuaaaguuguggcugccagacuugcccuuuuuaagguauucauucccuguuuguaauuaacuaauauuuugcgguaggugcuuugaaacuauguaaauauuuuguuuuguuugucauauuuuaaauucacuuauuuacauguaccuagguuuaucuucgcaaggacauaaugcauuacuauuuauuuuggugcucaaauuguucuugauuggccagugagaacccccuggcuuauuuucuuuuuuguuuuugauaccucuuccuuuuuugaguacuccuuguuuuuuagcacaauuagauguucuaacauaucuucuacuuuuccugguuguuuuuaguggaaaaugauacuuagaagccaagaucuggggcuuguguacauuguuguuuuuaggguauuguuacucucaggcccucuucauauacaaagcuaggaaauauuuuuauguacuuacacauauuuacaucuauuuuuauuuauauaucuauaaauauauacaauggucccugauuuauacuucuuugacuuuaccagggguuuuauugggguacuaagugcauuuucaaccugugauauuuuuggcuuaaaugauggguuuauccagauguaaacccauuguaaaucgaggagcaucugcauauuucuauaaugcaauucuaauccagcaccaccagguucacucuaaguuguuuuuuuuccccuuuccauacuuguaacuuaucucuaacagugagaaauaguuuuguuuccauauguuaugugugugaggaaguuaagguaaacauuuguucaaacauuuuugagccagaagugucugcaguccaauuaauuucugaaguauuucuaaagagauaaaauuccaaacuguaaaaaggcaaguuuuaauuccgugauaaaguacauuuaugugaaauauuucauuccuuaguaauucuugaggcgacugugaaaggaggauggaagaaauccaguacuuuuacucuuuacauuggacaaguuauuuguggagauaauugcucaauuucaguaugagugcagugauuuugaugcaguuguguuuuucuuuuuuauucuuuuuuggagaagggucucgcucugucgcccaggcuguagugcaguggcaugaucacugcucacugcagcuuugaacucauggccucaaucaauccuuucaccucagcauccugaguagcugagacuacaggcauaugccaccacgcccagcuaauuuuucuauuuuuuauagagguagaggucuuacuauguugccaggauuggucuccagcuccugggcuugagugauccuuccaccucgaaccucccaaaguacugggauuacaggugugagccacugcacccagcugugguuuucauauauucagguuauauuguuugcaugauccugaagucuugaagcaccuaauaaugguguucuuggaauuucacaccuuaggucacucuagacucuuugugggagcauggagggaggucugauggaggggggguggggagaggaggguauguuuguaguaggaccagugcaagaaacuagugaucuaaaaaugaaucuuguugccaagguuaucacacaaccuagaauaaguugguuugacuuuccucuuccuuauagauuuuggaagugauuuaagaggcauauccuuugagacuagaauaaaucucucagucuucuaggaaaagauaaggaucuuggcagcaucaaauggauccuuugggugcccuauuaaucccuggggacuucagaagauuuaguuuauugucuugaugcugacugcaaaauagcagggacuguauauaguagaugcuuuuugauuugucguggauaccugguaucaacagaggguccugucugcucuuuuaaaagccauucccaagccagggacccuaggagucaucuuuauuuuccugaccuuaguaauugaaauuucugucgauucugucuuacaaaugucuacagagugagacacuuuaggguaggauaggaaggcuggauaaggugaagggcuuuugauaggcagaggguaaaaacaauuaccuuaaucuguuuuuuccccaauuauaaaaauaaucuugcuguaaaaauucaaacauagaaauauagaacauagaagaugaaaauucuccacaauuccaucucccagauauacuccgguauguguaguuaaaauugauagcuagcuagaaucaaauucccucugaagaguguguaucaauuuguacuuccaucaaugguauauaaaauuaccuguaugcauuuuugaccaaaauggguauugguugucuuauaauacuuguggacaucugagagaggcaauauaguauaguauguaagaacauaaguuuuggagucagauugccuggauuuaaauccacgacuuacuaauuaugacauugaaaaauuaaaugucaauucuuuuagguauaguacauauacagugugccuuuuguguucuacaugguuuuuauugauguguugcuuauccuuaugcauuggcucugguguuugccauauggaugcuuaaauuuuaauguaaucaaauuugucagucucuuuaugccuuuugguuuuaauguuauuauuggaaaguauuugcaccaagauuauaaaaguaauaaccuagcuuuuuaaauuuuggcuuaaggagugaaaaaauaaucuagcuuuaugcuccccaaauuucuaacuaguuguagugccguuuguugaauaaucguuuuacuucugaaagucugccuuuaucaauaguaaauccccaaauauguuuauacuaugucaggauuuucuuuuuuuuauuuguuguguuuuuuaugauacuaugcuauuuugaccucucuccccuucauuguauauuuaauaucuggaaguguugcuuuguuacucugcuuuuaaaugaauuuuccagguggacaugaaucauuuuuaucagcuucuaaaaauaauucuuggccgggugcgguggcucaugccuguaaucccagcacuuugggaggccgaggcgggcggaucacgaggucaggagaucgagaccauccuggcuaacacggugaaacccugucucuacuaaaaauacaaaaaaauuagcggggugugguagcaggcgccuguagucccagcuacucgggaggcugaggcaggagaauggcaugaacccgggaggcggagcuuguagugagccgagaucgugccacugcacccagccugggggacugagcuagacucccaucucaaaauaauaauaauaauaauucuuggugguauguugauugagagggucugcauuuguagauuaauuuagaagaucauugauaacuuuacgauagcauaucucuuucuaggaagauagauuucccauuuauuugauguuugaugcccuuuaguggcauuuaugauuuucaucuugucauaucuguguuucuuguugauacgcauauuuguuauuuuuaagaaaccauauauuuuuguuauauuuauuucuaaaaacauuuuggagggagggcaagggcuucuguuuuuaugaggcuauuucaucaauugcauuauuaucuggcuauuuaaauaaaggaagcaauugaguuucauguuuauuaucuacuauagugaugacuuuugaagaauugcuuuuaguauuuuaguugauauguuuguauuuucuggguguauaguaauagauucgugagcaggcauaggucuuuuuuuuuuuuuuuuuugagacagggucucgcucugucacucaggcuggagucaguggugugaucauagcucacugcagccuugaccuccugggcugaagugacaggugugcacaacccaguuugcauauuuauuuguagagauguggucccacuccguugcccaggcuagggcugauucuguuuuguuuuuuuucuugagacggagucuuccucugucacccaggcuggauugcaguggcgcaaucugggcucauugcaaccuccaccuccuggguucaagcgauucuucugccucagccuuccaaguagcugggacuacaggugcacgccaucaugccuggcuaauuuuuguauuuuuaguagagacgggguuucaccauauuggccaggcugaucucgaacuccugaccuuaugaucugccugccucagccucccaaagugccgggauuacagcugugagccaccgcgcccggccaggacugauucuuuuaaguagaaauuggucccugcuacuacucuucugccccuugaaggugucaucagucauaugagaauggccucuucaaccuuguuguuccugaacuggauuuuuauuuaucucuaagaaauuaauacuaauuauaaacauuuucuuugaacugcuuaguauuuagugugauguacaguaauagagcuggcccgcuuuauccauggguuacauauguauggauuuuguagucaugaauucaaccaaucaugaauugaaaauaauuugagaagaaaaucaauaaaaaaauacaauagccaggcaugguggcucacaccuguaaucccagcacuuugggaggcugaggcggguggaucacgaggccaggagguggagaccagccugaccaguauggugaaaucccaucucuacuaaaaauacgaaaauuagccgagugugguggcgugugccuguagucccagcuacuugggaggcugaggcagaagaauugcuugaacccggggggcagagguugcagugagccgagguugcgccacugcauuccagccugggcaacaggaugagacuccaucuccaaaacaaacaccaauaaagaacaauacagauccagcccagcaucuucaccaagagaggugccuccgcucucccucucccucucccuuucccucuccccccucucccucuccccacggucucccucucccucucuuuccacggucucccacugaugccgagccgaagcuggacuguacugcugccaucucggcucacugcagccucccugccugauucuccugccucagccugccgagugccugcgauugcaggcgugcgccaccacgccugacugguuuuccuauuuuuuugguggagacgggguuucgcuguguuggccgggcuggucuccagcuccgaacugcgagugauccgccagccucggccucccgaggugccgggauugcagacggagucugguucacucagugcucaauggugcccaggcuggagugcaguggcgugaucucggcucgcuacaaccuccaccucccagccgccugccuuggccucccaaagugccaagauugcagccucugcccggccgccaccccgucugggaagugaggagcgucucugccuggccgcccaucgucugggacgugaggagccccucugccuggcuacccagucuggaaagugaggagcgucucugcccggccgccaucccaucuaggaagugaggagcgccucuucccggccgccaucccaucuaggaagugaggagcgucucugcccggccgcccaucgucuaagauguggggagcgccucugccccgccgccccgucugggaugugaggagcgccucuacccggccgugaccccgucugggaggugaggagcgucucugcccagccgccccgucugagaagugaggagacccuccgccuggcaaccgccccauaugagaagugaggagccccuccgcccggcagccaccccgucugggaagugaggagcaucuccgcccggcagccaccucguccgggagggaggugggggggucagccccccgcccggccagcugccccguccgggagggaggugggggggucaguccccccccccccggccagccgccccgucugggagggagguggggggggucagcccccugcccggccagccgccccguccgggaggugaggggcgccucugcccggccgccccuacugggaagugaggagccccucugcccggccagccgccccguccgggagggagguggggggucagccccccgcccggccagccgcccgguccgggagggaggugggggggucagccccccgcccggccagccgccccguccgggaggugaggggcgccucugcccggccgccccuacugggaagugaggagccccucugcccagccaccaccccgucugggaaguguacccaacagcucauugagaacgggccaugaugacaauggcgguuuuguggaauagaaaggggggaaaggcggggaaaggauugagaaauuggaugguugccaugucuguguagaaagagguagacacgggagacuuuucauuuuguucuguacuaagaaaaauucuucugccuugugauccuguugaucggugacccuacccccaacccugugcucucugaaacaugugcuguguccacucaggguuaaauggauuaaugguggugcaagaugugcuuuguuaaacagaugcuugaaggcagcaugcucauuaagagucaucaccacucccuaaucucaaguacccagggacacaaacacuguggaaggccgcaggguccucugcauaugaaaaccagagaccuuuguucacuuguuuaucugcugacccucccuccacuauuguccuaugacccugccaaauccuccucugugagaaacacccaagaaugaucaauaaaaaaaaaaaaaaaaaaagaacaauacaaauaacaacaauauagcaauuauuuauguagcauuugcauuguuuuaggcauuauaaguaauuuagagaugauuuaagguauaugggagaaugugcauagguuauauacaaauacaacaccauuuuauaugagggauacuuggagcauccucagauuuuggcauaugugaggguucuggaacuaaucccccauagauacugagggaugacuguaauuauguauaucauuaaaugacaguuauuuugagccuuuauuuaauuauuguaguaggcuugauguaauuuacauguaugauaaacauguaaaugugugacaaggaaaaggaucuuugucacuacuuauacccuaagguuuauuuuugucccauguguuucauagaccuuaaccuuacccuuucuuguaguauuuuuuuuuugagacggagugucguuuugucgcccaggcuggagugcaguggcacgaucucugcucacugcaagcuccgccucccagauucacuccauucuccugccccagccuccugaguagcugggacuacagguacccgccgccacgccuggcuaauuuuuuguauuuuuaguagagaugggguuucaccauguuagccaggauggucucgaucuccugaccucgugaugcgcccgccucggccuuccaaagugcugggauuacaggcgugagccacugcgucuggcccucuuucuuguaauauauuuaacagauaauuuugugugaaugauagguguguuccccagaauacugauguuuuccucauacucacucacuaucacuguaaaugacuagucuggaguaccaccucuuuuuucuuuuuaauuaguacaacaggaagcuguuagaccaguuggagaagugaaauguggagguaauuuagcuuauuaaugacauaacucagauuagaaaaagaaauccaaguuuccugacucuguugguuuuuuuugcuuauuauaccagcauuuuccuagguauguucugaagaauacaguuucuuuagaauaauacuauuucccaaagauuuuuaauagguguuagagaaaaaaagaguuuugggcucaucuaagugaggaaauucugaguugauagaccugguuuuccaucuucucuuuggcggacgccaguuuguuauagaugauuauuuuuuuaguuuagaaauaacuggauacagcuuaauuuacaaaaaaaguuuacaucaauauuugagccaagaaguuucagagaaagauuuauccuuaaaguaguguguaauucuucaugaucucaaguuuuaaaaaauagacuuaaggcugggugcaguggcucaugccuguaaucccagcacuuugggaggcugaggcaggcggaucacuugaggucaggaguucgagaccagcuuggccaacauggugaaacucugugucuacuaaaaauacaaaaauuagccgggugugguugcgcaugccuguaauuccgccuacucgggaggcuugaacucaggaggcggaggcuguggcgagcugaggucacgccagugcacuccagccugggugacagagcgagacuccgucuccaaaaaaaaaaaaaaaaauagacuuuaaguuuuuugaguaguuucagguuuacagaaaaauugauuaagaaguguaaaaaauucccaaacccuccuucuccauuuccccuauuauuaacaucuugcauucaugcaguauauuuguuagaauugauaagccaauagugauacauuauuauuagcuaaagucuauuguuuauauuaggcuucacucuuuguguuguacauucuguggguuuugacaaauguauacaugucccugauuguugcugauaauggcaacaaucuguucaguaguuauagcuuauggaugagcgaaaugaauuacaggaauguuagaagggaugagaaggaggaauugggaauacucucuaaucaggcacuugcauuaccuaagaucagauuacuuuuuuacugacagcauaugugggaauaauguauuacugauguugaaauuaccuguauugaaucuuuggaagcagauuuuuaaaguuaucucuucuuuaaaaaugauuaucaacauuugguaauccauguucacaauuucuggaaaacugaaauuugaauguuggcguguuuucauucugagaaaugauuuaaaugaaaguagaagcucucccaucauuacuuuuuuuaagucauugcucuacagcucuuaguuggccucuuuguguacauccuguucauccaaguccaacucaaguaccauuauuuccacugaaacuuccacccaauguuuaaaauuucccuucuuuggauuuauauauuuuucuucugaacuuuuuuguugugauaaaauacaaauaaaauaucuuaaccauuuuuaaauguauucuacacugguauuaaguacauucauauuauuguauacccuucaccacuguucaucuccagaacucuuuucauuuugcaaaacuuuaacucuauacccauuaaacaauaacucccaaagccuccuagccgcuggcagcuaccauuuaacuuucugugucuauuauuuugaccaaguaccucgugagucacuuagcauauuguccucaagguucaucuguguuucagcauaugucagaauuuccuuccuaagaccaaauaauacuccauuguauguauauaccacauuuugcuuauccauucaucuguggguagacacugggguugaugccauauuuuagccauuguggauaaugcuguaugaacaugggucgauaaauaucuccuugagacccagcuuucauuucuuuuggauauauacaccgaagcggaauugcuggcucauaugguaauucuguguuuaguauuuuuuuuuuuuuuuuuuuuuaaggaaccaccauauuguuuuccacaguggcucuaccacuguauauuuccaccgaaaguauacaagaguuccaguuucucuacauccucaccaacacuugcuauuuuguuucuuugauaauagcaauccuaaugggugugaggugguaucucaucauggugguuguugguuuuuuuguuuuuuguuuuuuguuuugaggcagaguuugcucugucacccaggccagagugcaguggugcaaucucggcucacugcagccuccucuuccucccaugcucaagcaauccucccaccucguccucccagguagcugggacuauaggcaugugccacccuaccuggauaauuuuuguauuuuuaguagagaugggguuucaccauguuugccaggcuggucuugaacucuugggcucaugugauccaccuuggccucccagaguguugggauuacaggugugagccacuauaccuggccuuauuaugguuuugauuagcauuuccuugauaauuagagaugucgaguaucuuuauauguacuuuuuggcuauuuguauaucuuuggagaaaugacuauucaaguucuuuguuuuugaguuggguuguuuuuuaguuguugaauuguaguaguuaauauauuuucaaucccagucuguuacuagauacaugauuugcaaauauuuucucccauucucuggguuuuauuuuuacucucuugauagucuuuuuaagaaaucaaaaagcaaauaucaaauuuaaagaaaaaaauggagcaaaugaucuccugaaaaaauucuguaucuugaucacauuuauuggaaugguuggagaaaaauaaaaauaccucuuagcuuaggaaguugugaguuaucugcaaaucuccucaguuuaggaguggaagaaucguggagucauuuauuucaaaauguaugcagguuucucuuuugaaugucuuacagauuuaaagaggccauugaaccaagucuuguauuuuucuauacaggauaaauuccuuguuucagccagcugucaguggaaggcaacuaguaugacaccaucuccauggacaaagaauguuggaauauuccauuucauugauuuauauaucucuuuaucuguuucuucauuaguuucuauaguagucaccguuucuuccaaugucauuuaaauguugaucacaugccuguaaucugcuuuuaaguucuuggucauuucucauuuucacauaaauuuguucauccaggaugagccugauggagauccaggagcuccuuuauggugcugguaauuuguuuuggguccauguugccugccguauuucaaacacugcacccuuuuccuccucucucgaauaguggcuuuggauuuauaacuuaaaaacugcuuagccauucaauuuaaaacuuaaauauauaaacuauuuuauguaguuuucuaauuguucuuggauauuuuaguugcuuuagcuaauuuucuuuuuaaaauaaaaauaaaguuaaaauucagaucucucuacuaccaguuuauaaauauguuucacuucagauuucucauugaaauuaaguuuuuauuuugagauaacuauagauucccauacaguuuuaagaacuacuacugugaggucuuguguaucuuuuauccaguuaccccagugguaauauguuucagaauuauaguauaauuucacaaccaggauauuggaauuuugguagucaagauacagaauaguuccaucaucccaaggaucaccuguuuuuuauuuuuauuuuuuauuuuuauugcuaucacagccaucucccuccuauauucccuuuacccccugcauuuugucuuuucaaaaauguuauauaaauggaaucaggcugggcaugguagcucaugccuguaaucccagcacuuugggaggcugagaugggcagcucacuugaacucaagaguucaagaccagccugggcaacaugaugaaacaucgucucuacaaaaauacaaaaaucaggugggugugguggugugugccuguagucucagcuacucaggaggcuaagauggagguauugcuugaucccaggaagucaaggcugcagugagcugagauuacaccacugcacuccagccugggugacagagcaagacucagucucauaaaugaaugaaugaaugaaugaaugaauggaaucauauaguacaugacuuuugggauuggcuuuuuacuuggaagauuccagaguuguugcuuauagcuauaauuuguucauuuuuauugaguaguacuccauggcauccaugugcuaccaauuuguugaaucauuucauguugaaggucaucuggauuguugucaauuuuuggcuauuagaaauaaaccugcugugaauauucauguagagguuuuucugugaacaucccaguuuucacugggauaaaaguauaagaguaugauugcugcgguguaucggauagaaacugccaaagaguguuuuccauagugguuguacuauuuugcauucccaccagcaguguaugagagaucuaguuuuuccacauccuagccagcaauugguuguuacuuuuuuuuuuuuuuuuuacuauuuuaaaaacuauucuuauagauaaggaguauaucucaucaugguauuucauguuagccuuuuccuaauggcuaauauguggaacaucuuuaacugugcuauucaacaucuauauucucuucauaucuguugcccauuuucuaacuggauuuuuuuuuuguaaguauugaauuuugagaguucuuuauauggauccguuuuuggauauauaguuugcagguauuuucucccauuccauaccuuaucuuuuaauucuaacagcaucuuuugcagaacaaaagcuuuuaauuuugaugaaaucccauuuauuauucuuuuauggauugugcuucuguugugaaguccaggacuuuuuggcuauuuuuguauccugaaaaauuucccuuaugcauuuuucugaaaguuuuauaguuuugcauuucccucugugauccauuuuuuuugagauggagccucugucauccaggcuggagugcaguggugccaucuuggcucacugcaaccuccaccuuccugguucaagagauucuccugccuccgucuccugaguagcugggacuacaggcacaugccaccacgccuggauaauuuuuguauuuucaguagaaucauuuaaaauaggaucccuguauguucagcuucauugauuauuauuuuuaacauuucuccuuacagaugagauuugaggugacacuuaauaggaugucaauacauaguuaauagaaguagaaaaucagauccaaggaaagaagugaagaaauacauuacuuuuaaguaauuuaacauaauugcugugauaaaacaucaaauuuagcuaagcuuccugggagccagaguuuucauuacccuaaaugaagaaauaugucacgaauucuccagaagagacaaauauuuuucuugcauuaaaucuuaaauaagcuggaugugguggcucacaccuguaaucccagcacuuugggaggccgaggcaggcagaucacgugaggucaggaguuugaaaccaaccuggccaacaugacaaaaccccaucucuacuaaaaauacaaaaauuagccaggcaugguggcaggugccuguaaucccagcuacucaggaggcugaggcaggagaaucacuugaaccucggaggcggagguugcagugagccgugauaaugccaccauuccacuccagccugggcaacaagagugaaacugcauuucaaaaaaaaaaaaaaaaucuuaaauaauuucuaaugugcacauuguuuauguaagagcuauugaauaaugaauggacaguguuguugagaacgauuuuacagcacguauucuauagcugucaagaucuuuuucaugaguucuuuuuuguuuguuuguuuuuguuuuuuuugagacaggauguugcucugugucccaggauguugcucugugucccaggcuggagugcaguggguugaucacugcagccugggcaucccaggcucaagcaaucuucccgccucagccucccaaguagcugggacuacaagugcgggcuacaaugacuggcuaauuuuuuuuuuuuuuaaguagagauaaggucucacuguauuucccaggcuggucuugaacucuugagcucaaaugauucuccugcugcagcaucccaaagugcugggcuuuaaaggugugagcgacugcauccagcugguuuuuuuucuauuuaaauaauaaaaagagaaggguaaaauauacaaaacgcucagggaagauaaauuauaugugaggguaggcuaauguaguuuacaaugguagauuuuuuuguuucuaacuugaccuaaagauaacauagacauagccauuuauggaaacaguauugcuuacaucccucuaaacaucauuauucuaauuuugauuuuugcuacaugaguaacagacaauuucaggacuuuauuuccuaaugaaaggaugacauacuggaguucuguuuugcguuuuuuuuuuuuuuuuuuugagacagagucucccucugucacuuacguuggagugcaguggcccaauuucagcucgcugcagccuccaccucacagguucaggcgauucucuugccucggccucucagguagcugugauuagaggcauuuuccaccauguccggcuaauuuuuguguuuuugguagagacgggguuucaccauguuggccaggcuggucucaaacuccugaccucaggugauccauccgccuuggccucccagaguucuaggauuacagguuugagccaccgugccuggccauguuuugcuucuugaugcaaaaucaauugaggaaaugguauguuuaguaucauauuaagaaaguugagaaauauuuauauuuacguagaagucccuuucuucuccacaagggcuacuugauauuauuauaaaguuuauaguuuauucaggagucagguauagaucuacuucuggcacuugaugcaagugcuuugaagaccccugaaaauacuaaagaauaugaggagauuuucagacuuucuaauaguuaccagucacaucugugcuauaaaaaaaauacugagucccagucccaggaaauauuuaauuucgggcaggguagugucucacuuuguuugacuguacuagcuaaaaaacaagcaaaaaaccccacuuucugguaauugaaggaggugaagugaaguguuaacacuaaaugguugaauguugggauaugagugcugcugucagacguaauuccuccagcuaauguucagccauuccuuuuucacaauaaguuaaauaacuggauuaguugucguuuagaaaaacuuuauuuugaaguaauuauauauuucuagaagaacugcuaaauaguccagaggauucuuaguaucaacaucuuauauagacaugguacauuuaucaaaacuaagaaauuaaccuugauaaaauacuauuaauuaaacuacagaguuuaauugaauuucaucaaguuuuccacaaauguccucuugcuauuuugggauccaguguaagagaccauguuguauuuaguuuuaugucuuuuauuuuuuuaauuuucauuuuuguggagacaguuuugcuaccuugcucaggcuggucucaaauuccuggccucaaaugauccuccugccuaggucucccaaggugcugggauuacaggcgugagccacuacaguaugcaggaaccuaaaauaucugcccagcccaauuuucagguauuuccccgcuccccugagauggaguuucgcucugucgcccaggcuggagugcaguggugugaucucugcucacugcagccuccgccucccagguucaagggauucuccugccucggccucuugaguagcugggacuacaggcgugugccaccaugcccagcuaauuuuuuguauguuuaguagagacgggauuucaccguguuagccaggauggucucgaucuccugaccucgugaucccccugccuuguccucccaaagugcugggauuacaggcgcccggccucaggucuuuaguuuccuccaaucugacaauuucucagucuuuccuuguuuuucaugacuuugauuuuugaagaguacugguuggauauuuuguagaauguuucuaaguuuggguuuuucugauuuuuuucaugauuauguuagauuguggauauuuagaaagaauaucacgcaagggaagugcuuuucuuaccauaucaagaaaaggguaugauauuaacauuauuuauuaccagugauuugaacuuugaucacuuggguaagguggugucugccagguuucuccacuguaaaguuacuauuuuuacuuuuccaucauggaucuguuagaagcccagcucacccuuagggugaggggagcuaagcucugccuucuugagagagaaguaccaaauaauuugcaggcauguuuaaaccaccauauagauauuuucggggagauacuuugauacuauuucuccuuaaagguuugacuaguaauuuuagcauucauauguauuuuuuuuuuuuccuguaggaucaguugucuuuuaagggguaugucauuggcauaugaaagagaauauggcauaguaagagggcuuguaucuaguucauguaaaaacuuaagccaguaaagaguaguaaaaaggggcaaucaaauacagucacuuuacacuuuugaaauucauuugaucuguaagauuguucuggaucucaauucuugcugugcuguuacauuagaagguagauuuugugaagguacugaucaccaaucaagugugugcuggacuguagcuggauucuauauagagacuaaaugcuggugacacgccgguggaagcccucaguuuaaccccauuagugaauuuuucaagugaaccuaaaauugguaugaugaggggaugcuaauucuaaagacugcuggccucuuaaguauuuuucacaucuuuuucccucucuggcaguuuaccuuauuuaguauuuagacuacuuagacuauuguguuucucucucuugcauuagaaauaaguuucaugagggcaggaauuuuagcuuuguucucuaccucauuaccuugagcaguaucuggcacauaauaagugcucaauaaguauuaugugaaugaaaaaauaauauuaagauaaagaauuuaagcugaaugagaaaucugucgugaggccuugauacguucaguuaaauaacuucuguaauuuugaaguuggaaaugguguguauuuuuagguccucugcagagaccagugaguaguaaauucaguaggcuuagucaccauagcuauuuuagagcaguguuuccuaaacuuuuauaauuuuuguaaacuuuugagcucaauuaaaugaaaaacaaaaaaucaaggaauaccaccucaauguugaauuuucaaaauagugguacuuaaauaucuccauucguaaagcuauguauaaaguccuuguuuuuagacugugguuacaguuauaacagcacaaguuaauuguauauaaacuauaacauuuauuuaaauuuucauuaauaccaaauucauauaacaaaugauguuuugcugaaauuuaauuggagguuguaucaugacugauucauuuguguuugacacauguaugcuguuaagugccuuaugauguuaauuuucuugucuuucucuuggaacugucgcaaguuuuggacaacaugucaucguggauuuacuuugcaaguuugaaucugcauuuauagauuuucugcuugugugauuuucccaauagaauguaaauacaauucagacauuaggacucauguucugugggaugacugccagacagauggcccuaaguauaauugaacgguauaccugaaaagucagaaaacacaggauacucuuauuuuuauaucuguuauauuuucacauaaagaaucauuagcuuuuuuuuuccccccaacuuucagacccguucacuggugcugaauuugaagcaguauauucuauuaaucugggggaaaaagcaccauagauauacuacagagaguccacaaagucuggaauaacagguuaaauacuguauuauacuucuaaaauuuuuauuuuuauuuuuuaaagagaugggcucucacuaugcuucccaggcacaaguucaguggcuauucauaggcaugaucauggugcauugcagccucaaacuccuggccccaagugaucuuaccaccucagccugccaaguagcugugauuauaaugagaccauggguuggcgccccugcuccuggcuuguguauuuguuauacuuuuuuuuuuucuagauuaacaauuggacuuacuguuuaaacuuugagauacuuucccugaaaagguauauggaaauagaagaaaaacauaaugagcauauuauaugaauauguagcuagcauacuuuaaaauuuuuuaugcuucuugacuuuacagauaccuuguauauuaauuugucuuaauuugaaacucauagaacuugugguuuacaguuuagugaauacuauuagcuuaaaggaucuuauccaaaugcuuuauuuagauugagaugauuuggagaaauaagccuuucagacaugcuugcgcuuaacuuuugugggucuaggaacaagaguacaaauggagugucacauaccguacgucuaauuuaaaaguuauaaaucaaucuuaaaaaagaacuugccaaaaaaaaaguuucguccuccuuccuucguaaguauaccauaauaagacccugggaggccagguuagaauuuaguauuuucagacuuguuggaguuucuuguaucagacuguggugguacaaaguuaccaucuggcuucugguccacagcccucucugcuucugcuuucuccacugcucguuacuacaauuaagaguauuugggcagaccuguauagacaucccaagcaacauguucacauccucugcauacaguugacucuugguacccuucaagccuaaggauacacagucuaguugguauaguuuuccuucuggaguacugaucuggugaaagaggcuuuggaagcuuguugagggcuguuugggcagauauuuuagguucugcauacccauagaaugauguagcauuaggggagaaaaugugcuccaguuagacaaguccucuuggcgcaauagacuccuugcuucauggggaggguuguauagcuggagugguacccccuaacucaaggaauccagggcuugagccacuguuguuuaggucuaagggauccauguugcuacauuucuguuuccugaaaacuacaguggucguccaagucacaauacucuaccuugggaaaauucaacugggauuuauuaugcuuuaaaaaaaauguaguacaaacauuguggggagauuugauaucaauuauuugcuaaguuuuucuugauaguucuacuuaacccacccaagugaauuuuuucuuuguuguuuugaaacuagaagcuuacugauauuaagacauggauuaucugggaauaguuuuugguugucaguccuuugauauaaagcagagguggcacauucauaagccaacacaucucauauugcauauaagcuaggaauguuuaggcugugggggauuguagaacauuaauuucgacauucuuuugugccuaugcaugaaauuagaccccccucccccaaacauuauagaccuggauucuuuuuuaaaauguaaaacuuacugauuucagaauguugguuucccuacacucguuacuccccuacacucucuacucuccuacccgcuaccccuuuuaaaacuguggugaccaaagaacacaucaguuggguuuaguuugcugacugacaguuggguaauaaugauguguggagggaaucagcuugucuuugauugagacgauauauuaaaagcgcauauaauuuaccccccaccuagauuguucuccucucacccccagauuguucucgagaguaauacauuuugaaaauaaucugugggggagaggagaaggaaaaaagagcugagcugcaacuccgguuucagagguuguguccugugcuugaaaaacacguaggaauuggugaaaauuagucuuuuuagucuaugcauugacucuugggaaaguauguugugcaagagaugagaguaacaggugagaguacuauacuguauuagaaagugagagagcccuuuguuccauguaagacagucuugccaguccaguuuugguuacauguggaccugaguacaucaaauuugaggauucaguuuaaugaaaaugaugaacauuguaacauuuuaguuugauuuguuucauagugcuguaaauacuacuucaugcuguuucuuuuuuguuaauuugcuuuuaugaauauauagcacuuaucuugauaaauauacuacaaaugugauuauuuauugagguuggcaugucccacgaaaguuuaaaaauugagugugaaacaauuuuagcaggaauaucuuugcucaaagaaugagguuuuucagaacugaaaaaaaaaaaaugcauuguaggccaggugcgauggcucacaccuguaaucucagcacuuugggaggccgaggugggggaucacuugaggucaggaguuugagaccagccugggcaacauggugaagcuccgucucuacuaaaaauacaguaauuagccgggcaugguggugggcgcauguaaucccagcuacucaggaggcugagguaguagaaucgcuugaacucgggaggcggagguugcagugagcugaaauugccccacuugcacuccagccuggguagcagagcgagauuccgucuuauaaaaacaaaacaagaaaaacaaaacaaaaagugcaccauagauucuuaggacaacuuuuauguuaaaaaaagucuuaaaaugguucggauuuuuaaaaaaugccaaccauuuuuuuucuaaagaaaauuaugcuagcacauaggggggccaacaagaauauuuaggaauuuuugugucuacaaaguaugugcugaauuagaaacacugaauuuuuuuagcuuuuggcauugcuucucaauugcuguaaucugcuucuugaaaagaaaaucaacucugaggggccggggaugguggcucaugccuguaaucccagcacuuugggaggccgaggugugcggaucacuugaggucaggaguucaagaccagccuggccaacauggugaaaccccaucuuuacuaaaaauagaaaaauuagcugggcaugguggcgggugccuauaaucccagccacuugggaggcugaggcaggagaaucgcuugaaccugggaggcagagguuguagugagccaagauugugccacugcacuccagcaugggugacagacuccaucucaacaaacaaacaaacaucagaauauagauugauauauguguuucuuugagaaaauuuucucauaucccaggugauuuuggcugucuucaggucaguaaguuguuagaauucagugacaacuacaacgguuuucccuuacacaaggcuuugccuucugcaauuucaguuacccacagucaacuacaguccaaaaauauuaaauggaaaauuccagaaauaauuuguaaguuugaaauugcaugcuguucugaguagugaugaaaucuugugccaucaugcaccauccagggcaagauaugaauuaucccuuuguuuaccauaucuauauaugauacccgcccauuagucacuuaguaguagcugucucaguuauuagagcaacaauacaugguguguauagaguucgacacuaucugugguuucagguauauucugagggaucuggaaauguauucaccccuaauaaggggagaccacuguauagcaagaagaguucacauuuguccaauguuauguuagaauguggcuguuguuagauauuaggaaugcucucugugguagagugucuacugcauuauugaaucuggugguaguuggggauuagaaacugaaggcccuucgggguguggguguguggugguaguggugauguuuuuuaaaugcccauauagcaugcaugcaugcauucauuuacuuaucuuuucacugaacugggaugauuaauaaucauacagcauucuuucaggugauuuuuuuuuuuuuuuuuuugagauggagucucgcuucugucaccaagcuggagugcaguggcggugugaucucggcucacugcaaccuuugccucucaggcucaagcgauucacccaccucagccugggacugcagacacucgccaccacacacgcccagcuaauuuuuuuacuuuuuuuuuuuuuuugguacagaugguguuuugccauguugccuagcugguuucgaacuccuaggcucaagcaguccaccugccucagacucccaaaguguugggauuacaggugugagccacugcuccuggcgggaaaaaauuucuuaaaaagaaauuucaaccuucaaaacaaaaaguauauaaaccugaacacaaguugugcauuuggaagaaucugcucuagucugccaauauuuuuucacccugaagcacaacguagcuggaguuggauuucuggugaacacuuuaauaauuccacuugaagaugacauuguuguaucaccagugaucuccacaauacacccaaaacggggauuuugaaaaguguugggauuacaggugugagccaccacaccuggcuuucuuuaagguaguauaaccaugcugcuauuuguguaugguaauaauauuacaagcagcuuagaauguaguuguuuggaugagucagaauauauuuaaccagucacuacuaagguauauuuauuuagcacccucucccauuauuuuuugcuauuauaauuuaacccuuuuugugaaacugugguacauaugucuagguguauuuuuuaguacagaucguccccaauuuaggaugguucaauguaggauuuuuuuuuuaaauuuuuauuuuauuuuauuuuauuuuuuuuauugaucauucuuggguguuucucgcagagggggauuuggcagggucacaggacaacaguggagggaaggucagcagacaaacaagugaacaaaggucucugguuuuccuaggcagaggacccuggggccuuccgcaguguuuguaucccuggguacuugagauuagggaguggugaugacucuuaacgagcaugcugccuucaagcaucuguuuaacaaagcacaucuugcaccgcccuuaauccauuuaacccugaguagacacagcacguuucagagagcaccggguuggggguaaggucauagaucaacagcaucccaaggcagaagaauuuuucuuaguacagaacaaaauggagucucccaugucuacuucuuuccacacagacacagcaacaaucugauuucucuauccuuuccccacauuucccccuuuucuauucgacaaaaccgccaucgucaucauggcccguucucaaugagcuguuggguacaccucuaagaugggguggaggccgggcagaggggcuccucacuucccagaaggggcggcagggcagaggcgcaccccaccucccggacggggcggcugccgggcggaggggcuccucacuucucagacggggcggcugccgggcggaggcacuccucacuucucagccggggcggcugccgggcggaggggcuccucacuucucagauggggcggcugcugggcggaggggcuccucaccucccagacggggucgcggccgggcagaggcgcuccucacaucccagacgggguggcggggcagaggcgcuccccacaucucagacgaugggcggcagggcagagacgcuccuuacuuccuagaugggauggcggccgggaagaggcgcuccucacuucccagacugggcagccgggcagaggggcuccucacaucccagacgaugggcggccaggcagagacgcuccucacuucccagaugggguggcggccgggcagaggcugcaaucucggcacuuugggaggccaaggcaggcggcugggagguggagguugucgcaagccgagaucacgccacugcacuccagccugggcaacauugagcacugagugaacgaggacuccaucugcaaucccggcaccucgggaggcggaggcuggcagaucacucgcgguuaggagcuggagaccagcccggccaacacagcgaaaccccgucuccaccaaaaaaauacgaaaaccagucaggcggggcggugcgcgccugcaaucgcaggcacugggcaggcugaggcaggagaaucaggcagggagguugcagugagcagaaauggcagcaguacaguccagcuucggcugggcaucagagggagaccguggaaggagagggagaccguggggagagggggagagagagggagaccgugagggagggggagggggagggaaauguaggauuuuuuuacuuuaugauggugugaagcaauacauguucaauagaaauccuacuuugaguaccaauacaaccauucaguuuuucacuuucaauacaguguuugguagaguacaugauguguucaacacuuucuuauaaaauaggcuuuguguugggugauucugcccaacugcaggguaauguaaguguucugagcaugcuuaaaguaggcuagaguaagcuaugauguuugauagguuacguguauuaaaugcauuuuuuacuuaaaccuaucauaaguggaaaauauuucaucggcauguaacccccauuauaagacaaggagcaucuguacuuuuucuaaggguaaauuuuuaaaaguagacauugcguauacacauuaacuuuauuuauacguguugucaaauugucaucaaggacauuuauacuauuauaugcuuccacuaagaaugcgauaauagaugugucuauauaaugcuagcuaacacgugguguuaccaguuuuuuuuuuaauugccaaucugguggaaauaaugguaauuugaucacuuaaaaauucaucuaaugaggugagcaucuuaaauauucuggccgguuuuauuucauuucaggagucauguguuuauugcccuuuuuucauuuuucuauggaggccaucuuauugauuuggaagaaguauuaauauuuagauucuuuaauuuuauaacuuuuaaaaacacaguugauaguguccuuugucauauguuuuauguaguuuaauauauuuuaugauuucuagcuuuggucaucuuacacaaagugaagucaagacucauacaauuuaauguaagagcaggagauuuucguuugggguugguccauggacuuguaaguauucugaggauggacuucauaguucucaaauacaaauugaauacaacauuggaauuacacauaaauuuuuauuuuucugaugacagguucagucaaauucaucugguucucaaaucguaugacacuuaugacugugugcccccuuuuauauagcauauauauuuaaaugccccuuuuuuucuguuucaagugaaauucauagguaguauaaucuuccaacccauacaaauaauuuaaaagaagaaaaagcaacaugauuuuuucuugacuggaacaaagaacacgugacagacaaaaauguuagaauacuuugccaugaccucauuagaaaauauuguuaaggcuuugcguuggaguuaacuggaaccuucaaaaaguguugauaccuguuucuuuuaaaauuaaacauacagcuacaucaguuccacuccuagguauuugcccaagagaggugaaaacauguccccaaaauguauagggagauuuauaacagcuuuaauaguccacaaauuaaaacagcucugcugucagucagcagaaagaacagauaaacaaauugcaguauauucauaugcuggaauacugcuccgcagucaaaaagaaugaacuacuuuuuucaugaugaaauguauaugaaugaaucucugaaacauuguguuuagugaaagaagucugauacagaagaguacacacuauaugauggauuauguuuauaugaagugcagaaaugaggcuauagcauuagaaauaugaggagugauugcuugguaggggcauugacuggauguggggcaggaggguacuuucugaguaguggaaauguccuguaucuugauugggguguuuauuacuccaagagaguuguacaccuaagaccucugcauuucgcuauacguaaacuuuaccucaaaaacaaacaaugaaacagagcgaaaauacugaugccuauguccuaccuucuagagauucuaauuuaauugguuaaggguguuggccugggcauagaugauucucaugugccgccagaguuaagaaucacugauuagaugcuuuugcccuuggauguaggcucuucaugaaugcaacugcuacucaugcagauugacaaccaaauuauaauuaagagaggcauugcuauccuugacaagauuuuuugaaguggagagacaacacuuggggaaauuucaagcaaguuuaaucuucccuuaauuuacaaucuguuaaacuaguguguaaaaaaacuccaucccuuugucuuuauauguuuacaguuagguucuaggcuuagauaauuauaauuuuuuuuucagcuucauggcuggaggacauuugaaaguugguacaggauauuaaccaucacuggccuuuggcaagucuauucauuuugacaacgaaaauguuaucauguauuuucaaaaugacucuuuugacaaccacugacugucuuaauucccuaaaccucccuauccauauguguuuaauuuccauuaaaagggaaaaauuuuaaacauuugauuaaaaaccuucuuaaaacauuccaauuuuagguccacaauuccuucuguguaauucugaaauucagaaauuccugaaaauugaacuuuucucuuuuuuugcugucuucacuuugcucccaguuaaaagggcuaccugaagagggcaaguggccuuaauuaugcacaagcaaguguucuggcacuauagucucaccccugggcaugaacuuuuuucccuaauucauuugguugauaaaaugugacuuacgcugaacugugaugugaggcugauacugguguuuauuuauaucguuuucccaucagaguuaauauuuguaaauuauacuucccugcagcaguauuuuccaaaaugaaaaauucucaauucugaaacacaucuacuggccugaagaguuuggauaagagauuguagaucuguauugccaauguauauguauuaauuguaauuauuaagagcaggaguuuuuaauuugugguugauccauggacuuguaaguuaacauuagcuagcaguuaaaguuagugaaaaugcuguuuuugaggggguugggagucuaauaaagagcaucuagacuuauuuccauuaggaaauuccagcuuuauuuuguaauacuaaguaugacuauugaugacuuuuuuuugucaguucucuuauucuguagucuacuucuuuuacauuugagguagagaauguguggugaugaauuuuagguaucuuugguggggagggugcuuuuugguuuugagagcaaguggucaauuugacucacaugauuccugugcugguaucaugggagcauacagaugagucacuaaugaggugccuuacauaguacuguaucuuuuuggugcugcagaaagcuaguugucugacauuuuuuaccagagaguuguuguaaaaccaaguaagguuucuuauaaguuguauauauuuuaaguuaauaucugaaagaaaugccugcuagaguaauuacuagagugcuugacuaugucgcauuuuuuaaagcuauguggauggaagagcaauuguuauuuguaaauguauaauguauauuaaagaugauaucugaauaaagagaaucaagagugagugcuuuuacauuugaaugcaaaaguucuauaggucagugauuuccuuccugacuugugucccaaaauguauauaaaauguguuugauuacaacauuucuucuuuucuucauaaauugccauuaugaaaauuuuauugggaaauuggagaaauuggcuauuaagcuacuagaaaaaugucagaauccauccauaaggcuucauaguuuaaaauacagguuuacaaauguguauguguguguaauuuggguguggaauaacuaaaaccaaauguuaggacuuaugcaacgugagagaagaaacugaauuuguauacuaugguucugccuaaaucuccguagcuuuuuacuauaacauaguguguuaaauaaugguauauuuauauuuagacauuucauaaaugaagguguuucauauuccugcuuuuauauuuaauacuggggaauuaaguaucuuaaauuauuuucccccucuuuuaguaauuuucaucagggcccacaauuuucuucaaacauaaggcucauccugagguuagaaagauaaacaaguaauacuugaacuggcaaaauuauuuuuccauuacuaauacucucuguguaacuaugcacuucuaauuaaagccucuuuaaaucugauauuguucaucaaugaacaguuugguuuaguaauacuaauuaaggaugguucuaaaauuuaaaacuuugaaaauuaggauuguuucauuuagucuaaugcuuuugauuuguaauucuuacagugguuguucauaggauauuaacuuuuccaguuaccagauaaagguuuuuuguuuuccagaugaucugucuugagauuaauuuuuuaaaacaacaaaauauacauuugucucauuugaguaucaggucauaauuccauuauucacagaaguuucaucaugugauugauuacuuuuuaaaagguaaauuuuugauagaauuaauuaaaauaacuacuuuagaauagcuuuuuauugcauaacaauaauucucauagauccauccaaauaaaggugaauaaauuacuuuuuuauucuuuuguucuuuucuaaaguaguuuccuauaugcauugguuguuauuauuuggaaacuauuaacugaguaauauuaaauuggcaacuuugagguaggauacaaccaaacaaauggaauucucaaguuaucacucugucaacuauaucuagaguuuacuuuugaucuuuaaaaacuuuacaugacagccuggccaacaccgugaaaccccgucucuacuaaaaauacaaaacaauuagcugggcaugguggcaggugccuguaaucccagcuacuccggaggcugaggcaggagaaucgcuugaacccgggagguggagguugcagugagcugagaucgugccauugcacuccagccugggcaacaagagcgaaacuccaucucaaaaacaaaacaaaaaccaacaaaaaaaacuacuuuacaugaaauucuuagggaaaauaaaugagaauguauuguuccuuuacaaaugaagauaccgcugcugaguuguauuugguagugaaauuuuaauauagacaaauuuuauuuuuuuauaagugauuugcguuuuugguaugacuauuuucuuucuuuucuuuuuuuuuuuuuuugagauggagucucgcucugucgcccaggcuggagugcaguggugcgauuucaacucacugcaagcuccgccuccuggaguauuaaauauaaaagccauucuccugccucagcuucccgaguagcugggacuacaggcgccugccaccaugcuuggcuaauuuuuuguauuuuuaguagagacgggguuucaccauguuagccaggauggucuuggucuccugacauugugaucugccugcaucggccucccaaaguguugggauuacaggcgugagccacugcgccuggccggugugacuauuuucuuucaaguugaaagucggguuccaugaaacucuaguauuagauggauuuaggugaagguuaauaccucugauuguuugaggccugaaauauaacuaauuaagcaguagugaaucucuuacuacauuugcuucaaagcagcuacuucauaauugaacgugugugucauuaauucuagaaaucuguuacacauugauuugguguuguaucagaggaggauacagaagaggaauggcacugacuagugguuuuaaggcacaauauuggaaucaccuggagagcucauaacauguacauaccuugacugugucccaggccuuuuggggcagaauccugcugguuggagaacaggcaguguaguuugguaaaaucuucagauaauucugauauacucauuuguauaagauuacugaaauucuauccucaaggaauauauacuuugucagaggaaggaaaacuauguacuugcaacaaacaugggcuguguauaaugacagcaauaauaauaaugauagccaacauuuguaugacacauauccugugcagaagcauugauuuucagguacugcagacauuugcacuaaucuugccucucuauagcucuuucucaauacagcagccagagcaaucuuuuuuuuuuuuuuuuuuugagauggagucucgcucugucacccagacuagagugcagugguacaaucuccgcucacuacaaccucugccuuccagguucaagcgauucugccucagccucccaaguagcugggacuacaggcgugggccaccacgccuggcugauuuguguguguguguguguguguguguguguguguguguaauuuuuuuuuuuuuuuuuuuuuuaaguagagaugggguuucacuauguuggccaggcugguuuggaacuccugaccucaagugauccuccccccucagccucccaaaguaccgggauuacaggcaugagccccugugccuggccagaacaaucuuuuaaaaacuuaaauuagauauuacucuucuuguuuaaaacuuucuaaugaauucucauugugauuagaauaaaauguaaacugcuuauuaugauuuauaagguggguacuuggucuguuuggguucugugaugucaucuuacauaauuguuucuguguucauuaugugguggucacacugguguuuguucccacauccaggcauuuauaccuucucuuuuggcuggauugcuuuucuccagaucuaugacaggcuguucuuaccagauuuguuuuuuguuguuuuuuuuuuuuuuuuuuuuuuuuuuuuuuuuuuuuuuuuugagacggagucucacucuguugcccgagcuggaguacagugggcgaucuuggcucacugcacccuucgccuccuggguucaagcgauucuccugucucagccucucagguagcugggacuacaggcaugugcuaccauuuuuguauuuuuaguagagguggguuucaccauguuggucaggcuaaucuugaacuucugaguucaagugguuugcccaccucggccucccgaagugcugggauuacaggugugaaccacugcaccuggccccauucuuaucagauuuaaccuucagugagauuucucucguucacucugucugaaguugcucuuccucugauuccucuccccuuaauguguuuuuaguucauggcacauaacacaaucugaauuuuccuuaucauuuacuauuguuuuuuccuucuuggaauguaagcucauuaagcccagacaucuuguauauauuuagucaugccuguauccucuugauaaauccaugggaucaaauagugucccuugaagcaucaucacaugcaaauaaaaugacggugcaguuaaccucuacuauaacaagguauguuaggcuuuuucuguauauguucucaugugaaauguuagaguugaacauuuucuguaaaauuguuuaauauacagucaugugccacauaaugacauuuuggucaaugauagacuguauaaacaauguugguuucauaacauuauaaugaagcugaaaaauaucuauucccuagugauauagcugucauaauuuuaaaguguauuacaugacucaugggguuguguugauguuuguguaaacaaacuuucugcacugccaguuguauaaaaguauaaguacaguuauguacaguacacaguacuugacaaugacaguaaacaacuguuacugguuuauguauuuaguauaugauaacuuuuauuaucuuugagugugcuccuccauauaaaaagguaggccgggcaugguagcucacgccuguaaucccagcacuuugggaggccaaggugggcggaucaccuguggucggaagauugagaucagccugaccaacauggagaaacccugucucuacuaaaaauacuaaauuaaccgggcaugguggcgcaugccuguaaucccagcuauugggaaggcugaggcaggagaaucgcuugaacccaggaggcagaggcugcggugagccaagaucgcacccuugcacuccagccugggcaacaagagugaaacucugucucaaaaaaaaaaaaaaaaaaaaaaaaaaaaagguaacuguaaaucauuccaugacaggaccuucaggaaguauuccagaagaaggcauuguuaucauaggagaugacaguuccgguuguguuguugccccugaagaccuuccagucagacaagauauggagguggaagacggauaguaaugauccugacccuguauaggccuaggcuaauguguguguuuguguuuucauuuuuaaccaaaaaguuuaaaaaguuaaaaaaaaauuucuuuuaaauaggaagaaaaaagcauauaaaauaaggauauaggagcugggccugguaguguaugccugguagucccaacuacuuaggaggcugaggugggaggaucccuugagcccaggaguuugaguccagccuggguaacauagagagaucccaucucuaagaaaaagaaaaaauauucugguuagcuguacaguguguuuguguuuuacaccauguuauuacaaaaguuaagauuuuuuuaaaaagaaaaaguuuauaacguuauaauaagcuaagguuuauuauuaaagaaaaaaaauuuuaaauaaauuuacauagccuaaguguuuauaaagucugcaguaguguacaguaguguccuagaccuucacauucacucacuacucacucacugacccacagcaauuuccagcccugcaagcucuauuuauaauagguguacuaguuuuuuuuuuaucuuucauaccauauuuuugcugcacuguuucuauguuuagauauguuuaaauacacaaauacuuaucauugugucacagaugccugcuguauucaguacaucagcaugcgguacguguucuuagucuaguggcaguaggcuacaccauauagccuagagguguaguagguuauaccaucuagguuucuguaaguagacucugugauguuuguacaaugaugaaauugccaaacagugcauuucuuagaacacauccugucaagcaaugcacgauuguuucuuccaacaaagaugccuuugguuaaucagaccuuauaccaauuauuuauugugaaauaaaccaucugaaacuuagugauauuauaaaccaagaagagucaucaguauuaccuaucaugggucuggggcucaucuuggcuuagcuaguugguucuugcucaaauucuuacgugguugcaguuagaugguugccagggccaugagccagagcaccugcgugugacuucucgguaagacuugaguuuccuuacagcaaguggcugguuucagagggcaaguggaugaaaggaaaagggcaaaagccuaaguggcaacuguauuagccuuuuuauccuagccuuggacgucauguagcaucacuucuguuauauuuuguuuuuaagaagcgugucaccaagaccagcucuuauuccaaugacggggaagaggauuucaccucuugaggggagaaguguaaaagaauuuguggaaaauguuauaccuaccacaaccucauucuacaaaauaguggcaucuuguugguuagggauuaaguucuaaagucaguguaaguagaagguaucaugauggggagaccauuauacauucucuguccggcacggugaggauuuucuauagguucaagaaaaagucacuguuucuucaacugaauaucaaauaagauauauuuggcuuguguucagugccuuucuuguguggaaaauauauuuaaguacuagaguagcauucagcaaggugcaauuaccagacuuugagaggcucuguggaaaagaaaauugacaucacuaucaaacuaguuacaagaccuacauuuauugaguaaagaaggaagguaggcagaauuacuugcauuauuacuuuuauuuaauuuugauuuaauuaauuaauuuauuugagacgaugucuugcuccguugcccaggcuggagugcaguggcccgaucuuggcucacugcaaccuccaccuccuggguucaagcaauucuccuaucucagucucccgaguagcugggacuacaagcgccugccacuaugcccugcuaauuuuucuauuuuuaguagagacaggguucccuguguuggucaggcuggucucaaaacuccagaccucaggugauccaccugccucggccucccaaagugcugggauuacaggcgugagccacugcgccuggccuauugcuuuuauuuuuaaauuuggagaaauuauguagcucaauucauaaauaaguagaugaacgaagcaacuacuuuguuuucccaaaucuuuguuucaaauaagaagggaaauaucgugauugagaggucucuucccuucuuuuaguaaaaauaaugcaauaccgcguuuaagggcauauaagugaaugagaguuaguauugaccuuaugcuacugugauauaugucaauuaaaaaaaugcuaaugugucaauuucgggaggauaaagcaaaaagaaaaaaaugcuaaugugagaacaagcaugccagcaagccauggucaccccacacccaauaaaacagguaaacaggaaaacacaaaaaguaccugugaguaugaauaguauauauaaaauauuuucaaagaaacaaguuacucuuauguaucuucaauagaaaggaaaaacuauuauuuauucagcuuauguauaauuauguuuucuguugcugauucaguuacuuuugggaaaggcaguacaaguaaagccacucaauauggcuuuguguuggacauucguaguuucuuagaacagcuaacgaaaauguagcuuuuaugcccuuuguuuuuuaacauaaagaaucugagauugaagagguaguguguucaggauuacagaaugauaaaugguggaaucuagacucaaauguaaagcaguauuauuuccaaagccagcuacuuuuguguucagcuauauuguuuuugaauuuucagugauuuauugguaggcuuuuuguuaucugggaauuccuucuauuaaaauuauauugucaaguguugaaauaugcagguuuuaacuaguugcauugacacagcuugauuuugugucacucuaaaacucacccccugcucccccagggagcaaaaacaaauaaaaaccacauauaaacauagcuuucuaggaacaguaguuucagauacugcuuccuaaauuguucaaauaucuuagcuuuucaguucuguuuguuccaagguggucauauauuguuauuuuucaauaaucagauuuaguuguuuugccauuuuuguuuagggaauuacuauuaauuguuuuuuaauauuaagcaugauaaacuucagauguuucucuuuuuaaagaccugguuuucguauauugagugguuucacuuuuguuaccuugccccaaaguaauugaaucagcaacagaagaaagcaugacauuuuaauugucuacgucaaauuacauaaucuagugaaguaugaagacuacacuguuaaauuauuaaugacuuuuguuuauuaaaccaagcagugaaagagaugguauagggacauuccccucauauuuuauaagucauacuacuggcuaaauaguaucaggauuguuuuuagcucugcauugcuaacugagugaucugucuaaaacuuaaauuagacuaugucccuccuuugcuuuuaagucuuaaaaacugcugcuuaccagucaaagucuauauuacuuaguaugguauuuaaagcuuuuaaguucuagcccccugcugacuacccuaacgucauuccuauauauuucaaagccuauccuaccgaaguuugucugcuggcaacacuaacuacuauuuuucuguauguagagagauucuacacuuugguuuauauauucuauucuguccuauuugacuguuuucccuuaccaccagacuauuuggucuccuuuuuccccacauuuguaacuuuuuauauucuuuuuaagacgugcucuugcucuuuugcucagaguugagugcagucgugaaucauagcucaucguggccuugaacuccugggcucaagcaaucuuccugccucagccucccaaguguagcuggggcuacagacguacaccagcaugccuggcuaauuuuauuuuuauuuuuauuuuuagagacaggguguuguuguguugcccaggcuggucuuaaacuccuggccucaacuccugccucagcugggauuacaggugugagccacugggcuggguggcuaucauguuuuaucuaaaauuagaaacuccuugaggcagggaccauuuaucuuuguaucuuuaguguucagcaccuaguaguaacucagcaaauguuuguuuucuuucugacauauuugucauauuuguauuuguuguauuuagcaucagaaagccaaauauggucauucaacguuaauuugacugauuccuuuuguuauuuuaguccagaauugcuaccaaaguguuuagguuugaccuuuuugugcccaggaagucuagucguuuugaugauaaaucuaaauugguugagguguaaugaaaaagacaaccaggugucuagaagugacugugacaauugcagauuuaucuuguuugugcaugcugguuuuuuuuuuuuucaguguucaaagccuguauugcaucagguuuucagguuuagauuuccuaaauuuggaacacaaaguucccuuuuuagaagaauagguauugagcccuugagcguggguagaaagauagagacagagugauuugcaaaauaauggaggaucauauuuauauaugaauuuucacuuauuugaacuuucagauaucagcucaaaagcuuugguauaaguaaaguauauuaaugagacuccuuggaugaaaguaaccaaaaccaguaaaaauaagguaauaaggauguaauaguuucuuauggacacucaacagcuagaaugcaguuagucucagaaaagaauuagaacaaauaacuggaaggccaucaggaguccaaaaccaucacucuuuuauauuuuauauuuuauuuuucucucuucagaugagcauucucuuucuauguccauaugguagaaggcggcagcuccauagauuauggcuucagauguuacaguuccgcuaaaugcagggacagacuugcuaucuuucagucccacuuacauauccuggggagagagcaaaugauugacuggcuugagucaggugcccguucccuuuccaaucugcuccaucuaggagggcaguguuaccugguaccaaaauagauguuagagggccaccccuuucaaaagggagaauagcucucacaacagggcuucuauguugugcagguugcuuauuccacaugcugcuugccaagcuguaugccuauaagggcugcaguuuuaaaauuuguacaaaggugcuuuauggauuugugguaaccuuuucucagagaaaggaggagucauugugaauuggggggcuauuccaagggggucugcuaugucauuuuugggggauauuuauuguccaucuuaguauugccagacucuuagcauugaaauauuagauugucucucacccuugggccauggaguuuuauugcagcaaaaacaaaaauccauauguauauaaguguuuucucaauagguauauugacaguggacuuacuaugauguggagcuuugacauuuguggaccugcugcgguguccuuacacucauugagaaccauugauguuacgcaaaugcuauuaaacuuugcaucuaagacuucuuauuuguccugugaccuuugauuauauuucaacaugcauaaaguacuuuagagagauggggagugccauguaugugaaugaacuuggcacuaagcaccccauaguuucuacagaaaaauuuaaagaauauuuguuacuuaaaauuaaguacuuucaaaauaauguuugguuaaguagaagcuuaaauuuuuguuuuucuucuuuuccucuccauaucuguuauacuauuucacuuacaaaauaaaucuucagccuuaagggauguuugggauaguuuuacaggauuauggauuuuauuccuaaaauagaucugaaugcuacaaaaagugaaacuuuuuaaagauaagauugucaucaaguggugguauuuuaaagcuuuacuuauaagcgguaauaauuaaccuuugaaaauccugcuguaauaagguguugagagugaucuagcuuucuuuggaagguuuuugguguuccuaaucauucccagccuaaauuaaccccaaggaaaaugagaacuucaaccugaccucucauuguuuugccaauuccuacguuuuuuucgguuuccuuuugguucuuuuauuucuguuccuucuguucaguuuaggggaaagaauaaacuuauaaagaaauucaccuuaagaaauuagggccuugucacauauacaccauggaauacuaugcagccauaaaaaaggaugaauucauguccuuucuaggaacauggaugaagcuggaaaccaacauucucagcaaacuaccccaagaacaaaaaaccaaacaccacaugucauaggugggaauugaacagugagaacacuuggacacaggaaggggaacaucacacacuggggccuguugugggguggggggagcggggagggaaagcauuaggagauauacccaauguaaaugacgaguuaaugggugcagcacaccaacauggcacauguauacguauguaacaaacuugcacguugggcacauguacccuagaacuuaaaguauaauaaaaauaaaauaauaaaauaaauuaaaaaaaagaaauuagggccuugucucuuccagauuaauuugcauuuuaauagaggauguaugaagagggaccggaagaaauaacuaaugguggaauuucaugcacucuggcacucacaucuaggauucucaaaucaggucaugcuuuucaacaggucugguucaguuucuagggcaguagacacacugcauaaaaacauuuuauuuauagucacuuucauuuaaaauaccacuuaaagaaccgaagaaguaauuagugucuugaauuggguagguggaaugaggagucaguaguaaggcaaaaggccucaccugaacaaaggguuugauucaguaguaaaguuguauaaaggcaaauugggaauagauuaaggagguuuggggauuaagaaauguuuuuuagguuuuuaaaggggaaagggagauaguaaaauaaaugauuuuaaggaaaaaaauuaggugcugacuaaauagaauuagggaaucaguuuagaaucuauugugcuaauacauaaaagugggcugaggccaggcgcugugacucaugcuuguaauuccagcacuuugggaggcugaggcugggggauugcuugaggccaggaguuugagaccagccugggcaacauagcgaaacuccaucucuacaaaauaaaaacuaaaaaaauaacccugaugugguggugcacacauguagucccagcuacuugagaguacccuugggccauggaguuuuauugcagcaaaaacaaaaauccauauguauauaaguguuuucucaauagguauauugacaguggacuuauuaugauguggagcuuugacauuuguggaccugcugcgguguccuuacacucauugagaaccauugauguuaugcaaaugcuauuaaacuuugcgucuaagacuucuuauuuguccugugaccuuugauuauuagaaagcaagcauagguugguagugaggcagagguaaugccuauagaggcagugcugcuccuguaucauacuggauggauaaaagcucacgucucauccuaucuggagagaauuuucagagaccaucuauaugcuucuugggagguuuaaguagauugauacccuguuaucuuuagggaugacauugauaguuacuacuccuuauauuggcuuuucuuccauccccaucuuaacucuuccugcuccuguaggucauucucuagacagacugcuuuuacucagguucuuaccucagccauugcuuuugggagaacccaaacuaagacagcagucauuagaguacuuaguauuuaaaagguagauaagaguucgggaauugaaacuggaugaucaccaaaggugugaguauauauagaaaagaaagccaagauauauguucuuuguaucauuaggaauguguuaagagguuggcauaaagaggagcaacuagcaaaggaaacugagguuugaccagugguauaggaagaaaacuaggaggauguguggugugauggaagcuaaaugaagaaaucucguaaaguaaggggaagcgaagcuacuaagaaagcaagggggagaagugaauuuagauugucuauugaauuuauuuuauuuaguuauuuauauuugagguggagucucgcucuguugaccuggauugcaguggugugaucuuggcucacugcaaccuuugccuccuggguucaagcaauuccccugccucagccucucgaauagcugggauuacaggcaugugccacgaugcccagcugauuuuuguauuauugguagagacaggauuucacuauguuggccaggcuggucucaaauuccugaccucaagugaucugccugccucggccucccaaagugcugggauuacaugcgugagccaccacauccagccauauuuuuuaauuuuugcaauggagucucacucugucacccaggcuguaguacaguggcgcaaucucggcucacuguaaccuccgccucccagguucaagcgauugucuugccucagccuccugaauagcuggaauuaugggugcccggcaucacgccuggcuaauuuuugcauuuuuaguagaaacgggcuuucaccauguuggccaggcugguugugaacucuuggcuucaagugauccaccugcuuuggucucccacagugcugggauuacaggugugggccacugcgcccggcuagauugucuauugaauuuagauguuuuaagaacuguuuuucuugaaaugauggggacaaaagugugauuggaguggauuuaggaacacuugauagaauaauugaagucagugcauguggacaacuuguuugaggaauuuuucuguaaaaggcagcagaguaauggguugguagcuguagagagagaugugguuucaggagagauucuuuuuuaagaugagagacaaaauauaccugcuugguauagcauauugcuguguguggucacaaucaguuuagaguauuuuagccuguuucucuuuguaaggauagacuuaauauuccccaucauaauuaggguucuuucuaguuaauuugacugccuuuuucuguuuccauuuagggcucccuaagucaugcauaaugaauucauggaggaaaagaaguuguuacaaguuacuaggagaaacaaaggugauugggaaguacucuggcauagacauaaacaugaggaagugaacugguggaauaccuguggggaaauuaauccugcuacaggaucguaucuuauggggaagaguuuagaauccagucaagacuguaugagaggcugggcacaguggcuuacaccuauaaucccagcacuuugggaagcugaggugcuuggaucacuugaggccaggaguuugagaccaucuggcgaacauggugaagcccccaucuccauuaaaaauacagaaauuaacuauauguaguggcauacacuuuaaucccagcuacuguggaggcugaagcaugauaauugcuugaacccgggaggcagagguugcagugagcugagaucgcaccacuguacuccagccugggugacagaaugagacugucucaccccaaaaaaagaaagauuauaugagaaagcuauuucuuuucuuuuuucuuuuuuuuuuuuuuuauugaucauucuuggguguuucucgcagagggggauuuggcagggucacaggacaauagugaagggaaggucagcagauaaacaagugaacaaaggucucugguuuuccuaggcagaggacccugcggccuuccgcaguguuugugucccuggguacuugagauuagggaguggugaugacucuuacggagcaugcugccuucaagcaucuguuuaacaaagcacaucuugcaccgcccuuaauccauucaacccugaguggauacagcacauguuucagagagcacaggguuggggguaaggucacagaucaacaggaucccaaggcagaagaauuuuucuuaauacagaacaaaaugaaaagucucccaugucuaccucuuucuacacagacacggcagccauccgauuucucaaucuuuuccccaccuuuccccucuuucuauuccacaaaaccgccauugucaucauggcccguucucaaugagcuguuggguacaccucgcagauggggugguggccgggcagaggggcuccucacuucccaguaggggcggccgggcagaggcgccccucaccucccggacggggcggcuggccgggcggggggcugacucccccaccucccucccggacggggcggcuggccgggcggggggcugacccccccccaccucccucccggauggggcggcuggccgggcggggggcugacccccccaccucccucccggauggggcggcuggccgggcggggggcugacccccccaccucccucccggacgagguggcugccgggcggagaugcuccucacuucccagacgggguggcugcugggcggaggggcuccucacuucucagacggggcggcugccgggcggaggggcuccucacuucucggacggggugguugccaggcagagggucuccucacuucucagacggggcggccgggcagagacgcuccucacaucccggacggggcggcagggcagaggugcuccccacaucucagacgaugggcggccgggcagagacgcuccucacuucccagaugugauggcggcugggaagaggcgcuccucacuuccuagaugggaugguggccgggcagagacgcuccucacuuuccagacugggcagccaggcagaggggcuccucacuucccagacgaugggcggccaggcggagacgcuccucacuucccagacgggguggcggccgggcagaggcugcaaucucggcacuucgggaggccaaggcaggcggcugggagguggagguuguagcgagccgagaucacgccacugcacuccagccugggcaccauugagcacugagugaacgagacuccgucugcaaucccggcaccucaggaggccgaggcuggcggaucacucgcgguuagggagaggguuaggggagagggagagggagagggagagggagcgagaaagcuauuucuagguuggaaacaaugucaugauuuaauuucccugucauauuaagcaacagcuuugugaauauacauauuugugaucuguauugucacaaaugucuuuuugcacaccuuuuauugaccuauuguugaaaauagccaagucaacucuaugcuaggaacaggugaaauuuacccacagacuuccagucuuuauuuuaugcaguuucaccuuuuccaaguauugcuaugagccuauauugagcuguuucuuuccucauucucucccaccuuuuccuucagauuauagaauggucuaaugucaguuuuucaugguuaauucugucugagauguuugcauuuguagucauauuucuaauuguggaaugaacgacuuuuucuguugaaaaaaaaauugaggcucucuuguuuccuaaguuacaucaguccugcuacacugagauggaagaggauuccacagauucuucaaccuugaucuacacuuuguaaaauagggcuagcaaaaauugguggacucaaggaagccuuagugaucugaauuucagaaauaacaagaguucuguguaggugaauguggcaguuugcccgccugggggcaggugccuaguaucaguauaggcggauaauauggagagacauugaagggauaggauaaaggcauucaagaauuaggauccuugaaugacagugugggcuuuagggaagaugugggacucugacagagccucaaaggcaaaaaucaaauaauuaagcaugaugcuugggucugucccuguuacauuuugccaagaagucgcaggagaggagaggauugaaagcauaaagaaaucauguaguccugcaaauucaaggagugcuuggaauuugggacccuguuggacuugaaucugaagguaaacugaaccaaaaaaguauuuggaacugcaacccaagcuucuacuaccucagauuugacaagaucgaaaaggugacugugggucggugauggggagguugggauuugggcugauuacagaugaauugagucuaauuaaagcugcugccagcucaaauggacucuacuagaaaucugaauuuccagccuuuauccugggagaaguagaaggaccuugcacucccugggaaauaacacuuaaaacaauauuauaguggggcgugguggcuuaugccuguaauccuagcacuuugagagguggaggcaggaggauugcuuuagcccaggaguucaagaccagccugggcaacauagugggacccugucuccacaaaaaauaaaaaacugcugacuguggugguggugcaugccuguagucccaacuauuugggagacugagguuggggauuacuugaaccugggagguugaggcugcagugagcugagguugugccagugcacuucagccugggugacugagacccugucuggaaaaaaacccgcaaaccaaaugaguaaaaauuauacugaauuucugacuauuaccuuacagugucuagaauauuauaaaauauaugaaacauacaaagaccuggaaaagggugauuguauaggcuuauagaugacccaauuauuggaauuaggagaaaagaacauuaaggcaauuggcaggauaauauaugggggauuggguauuuucaggugaguaauggacaugccaaaaaaccaaaugcauauucuggaacuggaaaauagaauaucuuaaauuuuaaaaauugaucaaauagccuuaauagcaguucuaugauaagaaauaaagacagaaggaaaugguaaaugugugaauaaauaugaaaguuuaucuucuaguuuuuaaauuuauaucgaugacaguggauagcacaaagacaaaaauaacaauguauuaucgaauuuauaguauguaucaguaaaauauaagagcacaaaaguuggaaguaaauauacacauacucuuuuauaguacuuagguuauaugugaaaugguguaauaucauuugaaaaugggcuaugaugaaugaagaauguauauuguaauuucuagagcaaccaaaaauguaggauagcuaaaaguccacaaaaggagauaaaauggaguaaaaggaaaacuuuauuagaagguaagaaaagaagaacaaagaacaaauagaaaauaaauaugauacugggugugguggcucacaccuguaaucccagugcuuugggaggccaaggcagggggaucacuugaggucaggaguucgagaccagccuggccaacauggggaaacccugucucuacuaaaaauacaaaaauuagcugggugugguguugggugcggugucgggcgccuguaguccaagcuacccaggaggcugaggcaggagaaucgggugaaccugggagguggagguugcagugagccgagaucaugccacugcacuccagccuggauaacaaagcaagacuccgucucaaaaaaaacaaaaacaaagcaaaaauaaauaauaaugugauaguuuuaaguugucauagcaauaauuacauaaaauaugaaagaucuaagcccaccauuaaaacagaaauugucaaauuugauuucuaaaaggacccaacauuaugcuuccuacaaauggguacuugaaauguaaagacauuugguuaaaaguaauccauggaaaauauauaccauauuaacacuaaucaagagaaagcuccuaugacuaucgugacaucaggcaaaauacuaaaagacaaggauuacuagcgggaaaaaaaaaaccucguaaugugagaaggauccauucaccaagaagauaugagcccuaaauaucuauucacuguauaaugaaucuccaacauacaugaaauaaauauaaaagaauagacaaauuuacaacuauaguuaagagaugccuauacuuuucgauaacuuacagaaaaagccauaaauugguaaggcuauagaagauuugaauacaacugucaaccaauuuuaucuaauugacauuuguagaacauuauacccaagagaggcaguaugugacauucauguacacguggaaccucucacuaagaauuacguggggcgucaaaagucucaacauauuucaaaggcuugaaaugauaguacuguucuguugacugcauuggaauuacauagaaaucaguaacaaaaugagguuugguagauuaccaaauauuuugaaauuaaggaagucaauuuugaacaacccaucaguaaacgaauaaaucaaauggaaaauuagaaaggacauuaaauaaauucagaaaagacagcaucaaaauuauuaaaugcagugcuuaaauuauuaaaguaguacucagauaauuuauaucuuuaaaguuuaauaaagaaacaaggauuagaaaguuuuauucuaaggacagaaaaagaaauucagaauaagugaaaggcagaaaauauagagaagaaagcagaaaucaaugaaacagaaagcauacucuaagaaaaugaacaaaauauaacauuuccucuuugaaaagaucaauacaauugauaggccucuagcaagauugacugaggggaauaaaaaaauccgcagauuacugguauaaaaaaugagggaggugcuuaugguacagauucuauagcuguuaacaaggauaaaaaggaaauaacuauuuaaaaauuuuguuuuaguuauuuuuaaacaacaaaaaaaaaacaauuguuuuagguaucuguuucuguguuaagaaucucuccaccacuuggcuuaaaacgauagcaguugacuauuucucugaauuaugugaaucagcauguggucuuuuaucucaggcuucuuuguggcauuguauucucagggcaacauucaaagaagguaaagguggacuuugcaaaucaugaggcauagggacugucacuugcccaacaaaacuuaugcugcauugaguugauguaaacaagucacaaggccugcccaaauucaugggguuggggaaauagauucuauggcaugauuuuaggugguguaaaacauucuggccauguuuuucagucuacagugguuaagucagaaauagugaaaucugagauuuuacccuauuuacaagcuaaaaaguuaagccugccagaaaacaauaccuuuagauuagagacaaagagagauuauuaccacaaaagcagugacuagagcaaugucuugugucaguucuuugagccuuaaucuucacagggugacauacugaaaguccuguaguaccugcucaugcaguaguguacguuacaggagaagaaccccaaauuggaaaaccugaucuuauuuaggacuacugguaaccuguccauccucuccucuggaguauaagcaaaucuuuucuggggaggggaagguggacucucugaaucuugcuuaguguuauuauccuagaaugucuuuauacaaacaccuuauguaaaugacauugcucagaggaccgagaacaugcaggaaugugaaauguuuauggagaauugucuuucaacccaguguacucucgaucacaguaauuugccuuccucucauauacaaaauuugaucacucuuuuccaaaagucuuauuccauuagaguaugaggcuugaugaucugucucaucaaaauaagaucuagauacagauaaggauccucaaagccauuuguaauuagaaaaaugcaaaauaaaaaccagauacugcaauuacauaggccaaaauuaagaaaacaguaccaaguguuggugagaauguaauuggaauucuauuugcugggaguguuaaauaauaaaaccacuuuguaagacaauaguuuugaguagaauuaaauuacuuauagacuaugacucagcaguuucauucccauauauuuaccuaugagaacagaagcauguguucuuauaacgcuuguacacaaauguacuuuuauucaggacaggcugucuuggucaggauguugacugggaaggggcaagugugaaccuuguagggugauggaaauguuccaugucuugauuccugcugguuauaugauuguauuucucuaccaucuauacucuuagaauguguucauuauguaaauuguaucuaaaaauauaaaaauggaaaauuuugcaaauguaaggauuccuugguaacuucaguguauaugucuaccacuuaauugcacaguaauacauuuuuagacauguuuaggcuaacuauaguuugauauaaaauuuuaacacuguucauauugaaauaauacccagcuuucuucuugaucagaauuaggcugaugggaccagacauugauguugaucuucuaguuauaaguaugaucuagccaucaacaucuuuuccuuauuucuuguauauguuguaggcauaucacauuuuauauauauuuaguuuuugacuguuguccuuauaaaugcucuuacacagcguuuauaauuuuuucauuacuuaaguucaaaaacuuuuuuuuuacucuucuuaccuuccuaucuuuauucuuuuucauauuauuauuuuaauuguuuacuauuuauguacuuaucaguaagggguuaauaauguucauaaaaugacuuggaacuaagcacaaauauaccaaauacagauuagcaacauugugauaacugugauuaaacuaaaugaucuuacacaaccacuaaauaccaucuaauaggugugggcaugccugaggaggcuuuguuuuacauuuuuacaaaaugaaauauugcaccacauaagauugcucuuaaauccagccgaguauacaugugugccuccaggcgaccccagagugcagccuugccauggccuccaaagcuucuccgcaucucagggcaccccccccaacugucuguggaucuggagaccuggcaucuaugaggaugacaaggggaggaccugggugacugugguugugcgccucaguccccugcacagagaaagggccaggugcucaagcucccagggcagcacauaugaaccuagcaucacagugcacaugugguagaugccagugcacacccgggaaccacugucccccagccagcugcccuucucccaccugcuucccguguggcagcucuaccccaagaggagguaucaagcagcaaauuccaguuucugggaaauaguggaccagaucgucuccauggagcagcugguccuaacauauuggccggcaaggaauaacugacuccucuggccucaugucucuucgggcccccucagugaggaucuuuguguacuugcuauuccguuugcacacccagcguggccuccuugcaggcaggaggcaguggggccccugcccacucagcuucucucauuuucuucacuuaucagucuuguccuguuccacucagaucuacacugagggcaguuggccuggaugggcuucacuaggggccccgucugugcacugggcccguuuccccugcuggcugcaagccauggguucuuuuucuccucucugccccucaugcugaccuucuagaugccacucccaaauccccuucacuccauacccaccaggcuucaugcccacccaggccucuggcacccucagugcagcccaugauugggaacucaccaucagcagucaguggcucgguuuaagagagggccgcagagggaacugggucuggauguggacuuggaugcccuguggguaucaguucugcugacacuuuggccugaaauagauaaagugcugagcaagcaguguaugcuggagccucaguaaguccaucugcacaguggggagcguggagggauggguuuggcuuaugcuucugcuuguucagucuuucagcucacagcaggaugcuaauccaugaaggugaccucgcaguacugguuaauuaagcuuuauugcucacugaaaaagaaaaaaaaucuagccagguaugucuugugaucucuuuagguaaauagaagaugugcuguauuuaaaaaaaaaaaaaccuuuauauugauuuuacuuuucaauuuuuauaguaauucucaaacugagacuuuugucaaaacaaucucaaguaguggauggggaaggcuaaauaauaguggcuaugguauagaugaaauaagauugaccaugcauugauuauuguugaaacuguguuggaaaaaggaaucacaugacauuuuuuuguuguuggcuugagacggagucucggucuguugcccaggcuggagugcaguggcgcaaucuuggcucacuccagccugugccucccagguucaagcaauucucucgccucagccucuugaguacugggauuacaggugcgcaccaccaugcccaguuaauuuuuguauuuuuaguagagaugggguuucaccauguuggccaggcggucuuaaucuccugaccuugugauccaccuacuucagcuucccaaagugcugggauuacaggcgugagccaccacgcccggcccgacauuuuguuuaagacaaagaauuuugaauuuuauacuguaccuuuuacuaaaucagaaucucuagggagaggguauaguaucuguauuuuucaaaaauaacgagugaauauuaacuagcuaguugcaauuacagccaagauuuguuuuucuuccucaugagcagcuuuuuaaauugguggcaaaguuuacuagggcagucuaugaaugguugcccaaauccuacuuacgaaaauuaucaaugagcuccucucuuucucuacuagauuguuucuaucuaucugucuacaaaucugcuguuguaucucuucauucauauucggguccggcaacuacuugauuuuucuaauguuuuauauagcaaaacuaccugaguugucgauucuaguucuucuguucuuucuugaaucccuuccaaauaguguuuugccccaccaaccagaggugguuuugucaagauaaucaaugacuuucacauuaauacacaguggccauucuaaguccuuauuaacagaguugauaacaucuuccuccuugaaacuuuuuuuuuuuccgccuggcguuuagaauaucacacuuuuucucuuggagugggguguuuucuuuugccucacuuggcugcuucucuucaguguccuuugcuggucaucuauaauguuuuggggcucagccauugaacuuguucucuuuuucugucugcccuccugcccuugaugaucucaucuuauuucauugcuuuaaauaccaucuauaagcagaugacuuucagauuuauauccacagcuuggaucucuucccacaucucugaaugccuauauccagcugcuuacucaguguccuacucagauaucuuucaaguauuucaaaguaaaguuuuugaauacaaacaucuuucuucucucugccuugcuccuaccauggucuuacuccauuucaguuuaguggcagcuccguuccaccagacugucaugucugugggaguguguaugagugacagaagauuugguggccagcuuugcuugcuguacacacagcuuuguuguuguuguuuuuuguggcaugcaguauauguagaauucuuagagaacguuaaacacacacguuaaacacguuaguccuauaccauuuggcauagcgacaaauaguuugauguauuuagggcaauucugaaauucugaaacacauaaauggauauuacucucaguuuuuaagaaaaagaugauuuaugauguauguacuuuuuauuaagaguauuauuuuguguuuuaggcugucucacuuuggaauguguuggcugcaaguaaagaaaacauagcaauaguuuaagcaaauaagggaauuaguuuucccacauaccaagaaauccagaaauagagaauaguuagcauuaauucagcuauaauuaauaaagcaaauaagggaauuaguuuucccacauaccaagaaauccagaaauagagaauaguuagcauuaauucagcauuaauugcuuagcaaugcuguuugaaaccccagcuuguuuuguuuuuuuccucugucagucuuauuuauuggcugguuauuaauccucauccuuguugacuuacgguaauaggaugguuguugcagcacuagauacuguguacacauacgaggcuagaaaaaugggagagugguggugucagauguauuugcucccuuuuaucaggaaagcaaauguuuuuccagaauuaaccggcacuucacccccaaagcagacuucagaauauaagucuuugauuuucacuguguuacccauuucuuguuuaccccuccaggcauggaaagcucaaaagugguaauugagcugggccccuuacugcccugaauagucuagagucuugaaaggaaggccaggucacaccuguaaacccagcacuuugggaggcugaauugagugggaggauugcugagccaggaguuugagaccagcuugggcaacauagugagagacugucuacacacacacacacacacacacacacacgaaaaaagaaaaacagguuagcugggugugguggugcacgcuuauagucccagccacucaagaggcuaaggcaggagaauccuuugagcccaggagguugaggcugaagugagccgugauugugccacugcauuccagccugggugacagagcaagacccugucucaaaaaaaaguccaggcgugguggcucacgccuguuaaucccagaacuucgggaggccaaggugguuggaucacuugaggucaggaguuugagaccagccuggccaauauggcaaaaccccgucucucuaaagaguuagccagguguuguggugcacaccuguaaucccaccuacucggcaggcugaggcaggagaaucgcuugaaccuaggaaguggagguugcagugagcugagauuguaccacuguacuccagccugggcaacagagugauacgucuccaaaaaaaaaaaaaaaaaucuuagaagggaaaauaaaucccauaaacaauuaacagugccugccacauagaacuaugaaaaauuacuaaaauauaauuggccauucgaguuuauuugcuuggaaaguuauuucucaguaaguucaaauuaauggcauuuuaaugguaggugaaagaguauuuauauaaugagggcucucaagaguuuauaaauguaugaagacuauccacuauaaagauagccauuuggcugggugcagugucucacguuuguaaucccagcacuuugggagacugaggugggagaaucgcuuaaggccaggaguucaagaccagcauggccaacauagugagacccugucucuaaaaaaguuuuuuuaaaauuagcugcguauggugguauacaccuguaguccuagcuucucaggaggcugaggugggaggauugauugugcccaggaguuugaggccgcagucagucauguuugugccauugggcugcagucuaggugacagagugagacccagucucuuaaaaaaaaaaaaagcuagucauuuauuuagaagcugguaaauaugugugugugugugugugcauacacuuguguguacguuuuuaagaggcuaauauuuugguuugacuauuuggucuuaacuguuuucaguuuacagagguuaauuuuugagaaguuuaauuuaacuuuuauauaaauuagguauuuaaagagauguuccuuaaagucauaaagauccguuuuuauuguuaauuuugguucuuuuuuugcuuuccauagaauguuggcucaauuaagaaacaucagggagauaaauucaacccagugguaaguaacuucaauuucuuuugguagaaaguuuucagcagccaguugcaguggcacaugccucuaaucccagcacuuugggaggucagugcaggaguuugagaccagccuggguaacauggcgaaacccccaucucuguagaaauuacaaaaauuagccaggcaugguggcugguggcaugguaguacccuugggaggcugaggugggaggaucgcuugagccugggagaucgaggcugcagugagccaagaucgcaccacugcacuccagccugggcaacagagugugacccuguuuccaaaaaaaaaaaaaaaaaaaaaagcuuauuauugugcucauuuucugggucgacacuuucuucuucguugugauuagaagauucuuaugucuacaguguuacuucugauuuauaaaguggcucuuccuuaucacauaccugaaauucuaaugagcaguucccauguugaucaauucaguucugaucaggcuaggcuuucuuccuuuuggauuauuuccuuguguuauucuguaaaggagaaucagucuuuggauacuguuacucauuuacuucucuuucguauguuacuuuccuccucugcccucaagaauuaagguucucagccuuucuuaucagucagcaguuuuuagucuauaccacuuccacuugcaggccuauauagauuugguguucguuuuuauauuggcaccaggcccacugaauuugaucugaggucuaaaccgcugucuuuguagucucuauucacagaaaguuuuccuuugagauuucaacucuauuuagcuuccuagagcccaaucuaaucuuucuuuucugaauucguucuccuuucagagaaguucugcaauuucuguuugucugucugcaacaugauuagcucuacagaaaaaaaaaucggaaauuguuauaucuccaugaacaauuacuugacccuauaaauugucuuauaucucaagugcccuacaucuuuauauguuaucuuuauauguuuggacccaguaugguccaguggccauuaaguguuuacaugugugacuaauaagcugaauuuuuaauuuuauuugauuuagcuuuuaauacuaaguguaaauagccacaugugucuaguggcuaccauacuggacauagcagauagaauucuuucccauucuuaaguguccuccuaacucaguaucaguuguauucuuaaaaugucuagaacaagaaauuuuguauucauuuuuggaauuuuuaaaaugaucucauaagcacauagguaaaaucuaaauucucuucuggcgauuaaaaucuuauuagaugaacuguuuauucuuacugauaaaauaugccuuaauauaaacaaagauuguuacuaaguaguaaacuuuucuggauauuuauuuguugacagagauuuuagauggaaacauuuaauguuugacaucugaguuucuuuuuuuaaauucugaaggaggaguauguagugaagauuuacugauauuugaauuguuuuaagaaccuuccuucaaguaugcauuauuauauauugagaagcaguauagaagagcacggacucaguuucuucauggaaaaaugcagauaacagcacauaucuuagaaaguuguagugacgauggaaugagagucugcauauaguuuaucuaaagaacuuagcacagugccugguauagagugacugaguaaguaggccgagugcaguggcucacgccuguaaucccagcacuuugggaggccaagacaggcggaucaugaggucaggagauggagaccauccuggcuaacauggugaaacccugucucuacuaaaaauacaaaaaaaauuagcugggcaugguggcgggcagcuacucgggaggcugaggcaggagaauggcgugaacccgggcagcggagcuugcagugagcugagaucgugccacugcacuccagccugggugacagagcaagacuccaucucaaaaaaaaauuguagugaugaugaaaugagagucugcauguaguuuaucuaaagaacuuagcacagugccugguauagagugauugaguaaguauaguaaaaaaaaaauuuuuuuuuuuuugagacggagucucgcuguguugcucaggcuggagugcaguggcacaaucacggcucacugcagccucugccucccggguucaagcaguuauccugccucagccucccaaguaccugggauuacaggcacccgccaccacgccuggcuaauuuuuuuguauaaagaugggguuucaccauguuggccaggcugguuucgaacuccugaccucuggugaucugccugccuuggucucccaaagugcuaggauuaccggucugagcuacugcgcccagccuagaauaaucacuuuuuuaaaaagauugcaagggaaauacauaucuuauucuuugucacuuuuaaaauaucauauaauaugaaguagaagaauuagaagcagugccuugcagaucccuguuacagcuugaggcaaaaggaaaaaucacuaauaccagauccugucuguauuuuaacauuggacauuuuguuuauacauggauucuuuuucaguaaucuguauuuuuaaaacauuuuauuaagauauuguauuuaucuugauuacugaauuuuuugauaccuccuuauauuuugugccugaguccuuacuagccuuaaccuagucuugguucugguuagagguaaucuaauacucuaauagaaucuucugacuacaguaagaauggauuguuuuacacagaaagaauugauaacacuaauuaucauuuuaauuuuauuuauuccuaaaauugcuauaaaauugccaauguauuugugugguguuugauuuuuuugguuuaauuuuaucuuagaguaugcugcacaauucaaauuuuuaaaagucgauuuuuaaacuuuuauuucuucaaguuaauugcuuuauuacuugugcaaauauaaucuuacuuugcuaauauaaucuuagccuaguuagaauuaaccuauguauauacauuguguacuuaauaaaguuggcccugagaauguucacuaauucagaauuggccuuuucccucaauuaauuugaaaucuguucuuuauuuaagcaaguuuuugcaccaguguguaaccuuaaacacauuuaagacauauaaguucuuuagaaaaacuauauggccaauauuuaauugaaacaaaauauacuugggguaggugggaauuuucauguggaaacuuggacuuuucauaggaagguuauagggugguugaucccugauggcugguuaagaagaccugaaaauaucuucgcauucccacuuccuacucaaaacugcacuuaaucauguccuuaaugaagacucauagaacucuuacucagaaauuaaguaaaauuaaauaaaaaucuucgucuuauuagaguuuuucuuguugaguacuaagaagcagacucaaagcacaguuuuuuuuguuuguuuguuugagucucgcucuguugcccaggcuggaaugcaguggcgcgaucucggcucacugcaagcuccaccucccggguucaagccauucuccugccucagccucccgaguagcugggacuacaggugcccacaccucgcccagcuaauuuuuuguauuuuuaggagagacgggguuucacucuguuagccgggauggucucaucuccugaccucguguuccgccugccucggccucccaaagugcugggauuacaggugugagccacugcgcccggccucaaagcacaguuuuugaagaagcauguaaauggcuacuucauggauugcuuugugaaguacuaaagagcuugaguuuaauuugaaauccaguaguuauaaauguggguauuaaagcaauguuaaauggguuccauugugcuuguauaguggcaggagaaguguuuaucugugacauaugaauugugauagauuggaaugauuuguucugaaaaaccguuguaauauguauguuuuaaauuucuuuuuauucgaauauugcagugucuaaaaaugacuacaaaacgaaguuuguuugugcgguugguaccaugucgcugucuacgaggggaagaggagacugucacuacucuugauuauucucauugcagcuuagaacaaguuccgaaagagauuuuuacuuuugaaaaaaccuuggaggaacucuauuuagaugcuaaucagauugaagagcuuccaaagguaugcuaauacuuucuuucaagaauuaucuuugguuauuuuuauaucuagaaauaugauauuccuaauauugcuauaaaguugccaauauauuugugugguugaauuuuuugguuuaauuguaucguagaguaugccguacaauucaaauuuuuaaaagucgauuuuaaaacuuguauuucuucaaguuaauugcuuuuauacuugugcagauaacguaaaauuuuguauuuaauuuuaguuguauuguagccauuaagguaaauaaugagacuaaauaauuucuggagucaguagauuuaacuagagcaauaauugaaauuaaugcugucuuuuccuacuuuucauaagacauuaauguguauuguuauaauugagggcaauuguccuuuuaccauaucauaauuuuauuguuaaacagcuuuucuugaguucauacagauauuguuuuccuccauuuacaauuuguuuggaaagguuuuggaggacuuaacauuucugaagucuaguaacaacugaaaggagaaaguugguuuguugccaugaaacaccuucucaaguuaucaccuuguuuuuuuuucacuaaacuuuuuucaguguacuuuuucuucuuaaaucccagucucucauuauccuauuucaauuuucccucucauuauccuauaccaguuaaauugcuauauauuuaauuguuaauugcuauauauuuaauuguugggaucuuuugccacccaaacagcaguguuuuugaaaccgugcguggagacccauugguagcucauaaaaucaauucaguaugugugggcagcauuuuggaaaaaaaacuauaaauuuggacugcgagaauuaggaaauauaggacgcuuaaauuagaauuuucaaauaaggaauaauuuguuaguguaagugugucccauaaaacugugggauauacuuguacuaaaaaauuauuuguuguuugucugaaauucaaauuuaauggacaucuuauaccuacuccugcaaccuuaauuauaaaaaauagaaaauagaguguguuguauauagccauuguuuuaugaaaauauuuuagauuuguguguauauacauacuggaugacaguaugcaacaggcuuuuuucugguggucaguaagaacauuuugaaagccacugcuauccuaggggucaucuuacagagaaaucuuuauauggcuauggauaaaaguuaaagguuguuggucucauguuuaugaacuagaaaccuagguugugguuggauaauuuacuguucuuccuuauauguuguucuucagcaggcaauuuaucuuccuuagcuaguucuagagaauauagaggaccaaaauuugucuccuucucuaaucaccaccaguagagucuugguuuagggguuuuggugaaaagagaaagucuugcuacaacagugcgaauaacugaaucauuuaugucuuaucacaccuaacacuuuuacauuuuuagaagaauacucuucuuaaauagggcuuucauuuuggaauaagguugcuugaaagacaagcuccagaguuuaucacauuuaguagccacuuauuuuuuuuacuaacucaacagaggauauagccauauacuuauucucacuaagugcauuuuacuuaagguagaaguaugaagauauaaauuaaucugaaugguucaguuguauucauauccauaauagcauaaccagaacaaugaggcaucuuuccugguauuaguguagguuauaacucauucaguuuuaauauggcugauaauaaaaguuaguucaugaaauauuuaaagauguauauaauugacauucuuuccucccuuuuuucaauagcaacuuuuuaacugucagucuuuacacaaacugaguuugccagacaaugauuuaacaacguuaccagcauccauugcaaaccuuauuaaucucagggaacuggaugucagcaagaaugguaaggcuuuuuuugcccauaauuuuuuguacuugggaacauguuucauuacuaagauuucuauugaguuuucaaaaauaaaaauauaaaaauaaguuaaaucuaauguauuaauaugaacuucaucuaagaauguuuuauguaaagauaguugcccgacuuuacaaguuuugccaccuguuuuguaucaaauacaguaaaauuaaauguuauagccuuggcuuagaauuuguuuaauauguguauguaaaaucugugauagcuuaaagcacauggagaauaaauguaagggauuuuuuuguuguuguuuuuacauuuuuaauugcggucaucauguugcaggauagaucucuugugcuuauuucuccugucaaacugaaaucuuauacccuuugaacaacauauuccaauccuccaucccugcuuccccauccccagccccugguaaccaccaugcuacucugccucugccucagcaagauuccauauguaagugagcuuaugugguauuuuuuuuuuuuuuuucuguuccuggcuuguuuuacuuaacauaauauccuccagguuuauccauguuauugcaaauuaacaggguuuucuucuuuuuaaaggcugaauaguauuccauuguguauaucauauuuucuucauucauucauccguugauggacacuuagguugguuccuuaucuuggcuauugugaauagugcuguaaugaacaugggaguguaaauauuucuucagcauacugauuucauucacuuugauacauauccaguagugggauugcuggaucuugugguaguucugauuuuuugaggacucuccauacuguuuuccauagcagcuauacuaauuuacauccccaccaacagugugcaagcauucccuuuucucgacacccucaucagcacuuaucuuuagucuuuuuacucauucuagcaggugugagguuguaucucacuguagauuuaauuugcauuucucuggugauuaaugauguugaacauuuuucauauaccuguuggugauuuguguguguuuuguugagaacuaucuauucaggucauuugcugauuuuuaugucagauuacuuguuuucuuguuauugagguuuuuuaguuucuuacauauuuugaaugcuaaccccuucucagauguauagcuugcaaacauuuucucccacuccauaaucuguuucuucacucuguuguuucuuuggcuguacagcugcuguuuuguguggugugaucccguuugucuguuuuugcuuuuuuugccugugcuuuuggggucauauuaagaaaaaucauuguuauagccauugccaggcuccagaaugucauggagcuuuucuccuauuuuuuuuuuccuaguaguuuuuuuuuuuuuuuuuuuuuaacaguuuuggguguuauaguuaagucuuuaauccauuuugaguugauuuuuuaaaugguguaagauaaggguuuaauuucauucuucugcauguggauguccaguugucccaacaccauuuauugaagagacuguccuuuacccauuguguguucuuggcaccuuugucaaaaaauaauugacaaaauacguggauuuauuuuugggcugucuauucuguuccauuggucugucuguauucaugucauuaccaugcugcuuugauuacgauugcuuuguagcauauugugaagucgggugugaugccugccguuuaguucuuuuuguucaccguugcuuuggguauucagucuuuuguggcuccauaugaaucauaggauuuuucuuuuucuaugaaaaaugucacuggaauuuugguagggauuggguugaaucuguagaccacuuuggguaguauggacguuuuaacaauauugauuuugaaguccgugaacacaggauuucuuuccauuuauugugcugcuucaauuuuuuucaucaaauguucuauaguuuucaguguauaugucuuuuaccucuuuaguuaaauuuauuucuaaguauuuuauuuuuuugguagcuauuauaaaugggauuguuuucuuaauaaccuuuucauauaguuuguuguuaauauguaaaaaugcuacugauuuuuguauguugauuuuuguauccugcaauuuuacugaauuuauucuaacaguauuuugguuggagucuuuaggguuuucuauauauaagguuauguugucugcaaauagggacacuucaauuucuccuauucuaauuuggaauccuuuuauuucuuucucuggguaggacuuaaguacaacguugaaaagaaguggcaggaauaggcauccuugccuuaucccagaucuuaaaggaaaagcuuucaacuuuucauuguuaaguaugaugugagcuguggguuugucacauauggccuuuauuguguugaggugcuuuccgucuauaccugauguguugagaguuuauuaugaaaggacguugaauuuugucaaaugcuuuuucugcauccauugagagauuuuuuuccuuuguuuuguugaugugauauaucacuuuuauauauauguugaaauuauuaaggccagguagucuuguuuaguauguuuaguuugauauucauuaaguauggaagauacguucuaaaauguuaaguccuuaccucagaaggagagagaaaucagcccuugaaauuuuuagaaugaguguguauuucuuuuauaauuacaaaaaagaaagaaucacaugaggauaaauuuuaaauggucugaccaaauauaggacuuucacuaaacgcuaaauacugucauguaauacuucuuaauaagaauuggggaaaaaacuuuauaaacaagucccaccaaguuagugcagcagugccagcaaauauguaguaaucauauuccacagcucuuagcuucaaagucauucuuuguccuaaugauaugaguauccagaaguaauccuucuccuaucaguuuuccuaaauuuuaggacuuacuaugaagcauuuuagggcuuauuagaauucauccuguuuucacaauuaacaguuaacuuuggaaagcuaauuaaccaggugucugucuacacacacacacacacacacaaaguuauguuggcucacgccuguaaucucagcacuuugggacgcugagguggguagaucacuugaggucaggaguucaagaccagccuggccaacguggugaacccugucuguacuaaaaauacaaaaauuagccaggcgugguggcacgugccuguagucccagcuagucaggaggcugaggcaugagaaucacuugaaccccaggagauggagguuacagugagccaagauagcaccacuguacucuagcuugggcgacacagcaagacucucaaaaaaaaauauauauauauagauauauauauauauuuauauaucuccacuuauuaaauucuguuuauuuuaguugcaggucauugaaauguauguuuuauaggauuaugaucaaaucaggacuucuguuuuaaggauuuauuauuugcuuauguucauccuagguuaaggugaagguuuuagugguuagugccguacugacguucaguucacaauaacuaauaaauuuuagcuuuaaagauaguacuguauuuuauuuuaccuuuuguuauugagcuguuuaacuuuagagcuauuuauauuuugaauaaauuuauuauuuaauuuuuauuuagauuggauucaugcauagugauguccugcuuuuuaucuagcuaucuuaaaaauuuuuggccaggcccaguggcucacaccuguaaucccagcacuuugggaggucgagguggaaggaucccuugagcucaggaguuugagaucagccugggcgacauagcaaaaccuuguuucuacaaaaaaucauaaacuuagcugcacaugguggcaugugccugugguuccgacuacuucaggcuguugugggaggauugcuugagccugggaagucaaggcugcgguaagccgugaucaugccauggcacuccagccuggaaaauagagcaagacccugucucaaaaaaaaaaaaaaaaaaaaaaaaauuaugcccaaauaagaaacauguguaaaagguaaaagaacacacauggcuccaccaguuguuagcauuuuguuacauuugucuuacuuuucuuuuucauguaugugaauuuaaauauguucaggaaaaagauauaugcauaucauugcuuauauaaaaugucuuuuuggcugugcgugguggcucaccccuguaaucccagcauugugggaggccaaggugagcagauuaccugaggucaggaguuugugaccagccuggcgaauguggaccccgucucuacuaaaaaugcaaaaaauaagccaggcuuggugguggacgccuauaaucccagcuacucgggagucugaggcaggagaauugcuugagcucgggaggcagagguggcagugagccgagauugugccauugcacuccagcgacaagaaugagacuccaucucaaaugaauaaauaaauaaaaacaaaagucuuuuugcuaagcuuauuuaaauuuaaguuggaggcaucaugucuucacuccuaaauguuuaaauaugcauccccuaagaacaggggaaucggaauaaccacaacaucauuaucacucuugagaaauuuaacaucacaauuccccuguugccuaauaaugcucuuuuaaacucuuuaggccccuucugcauaucccuccuuacaaguuaaagaucauguacagcauuuaguuguugugucucugguccuuuuaaaucaggaacaguuugcucaugauuuucaugacaauuuccauuuuugaaguguuuagaucaguuggcuuuugauuugugugacuauuccucucauuauuuuauucaggcuaaaugucugccguuucagacuuuuccuugagggcagugugaaauuuguguuuccaucccuaguacuuaguauuagugcuugguggugccugauacauuccaaaguaaaugaauuugauuaccaucagaucucuauggauguugacacauaauccagaguauuauagaauucuagaauuauugucacuuuaguugucaucauaucuaccuuuucauccuaaaggaguaucucuacauauguugacagauaaauuaauccagaguauuauagaauucuagaauuauugucacuuuagaagucaucacaucuaccuuuucauccuaaaggaguaucuuucugaucuuuuuaaaugggaguuguuaagguauaaggaaagggacucaagauaauuuggguauugauuaaaaaucguauacaucugaaauuguauguauuggguaaacuuugcuaucagucuuuaugguauagaaguauugcuuggcucaguaaugaaaauaacuugcauauaugcuucaugaaaauggauuaaccucauguuuauuacucuaaaaugagaaugguggaauuauggcuauguucuaacccuacagcaucauuaaauuaauauccuaggcuuuuguauaacuauuuaaagaauuacauguuguagaguuaggcaaccuauuagacugcagaguagcucuuuuaccuuucuaguuuagcauuuuguuguugcuucuacuauauugaaaacuuuuaaacaauuauuucaaccugugaauguuuuugaggcguuggagauaaucuuuaugugaucaaaagauuuaggaaaaguacuuaacuguucuuccucaaggaggaaugacguuacuuauugcugccaauaagucuuaguuuauuugacuaaaaauuaaauuggucuguucuuguuauaugauuccucacauagaagggaccacaucuauucuuuaacuugcagaauugguuuuuuugcauuuuacuuguuacuuguauuuucucuccuuuuagucuugaauugaugucuaagugaaacuucacuucauuguucauaacaaggcuagcugaaaggagacaagagacuaugauagugucagaaguuaccuugccaaguaaaaauucuaguuauuuuaauuccucaucuuauauucuucauaagugguguauuuaacccauuuuaccuuaagagagcugagauaauuuuaaucaaccuguaguauucaacccuaauauguauguuuguauaggucuauuguguugaaaaaaaauuaauaaagcacacauauuagguugcauauuaggucgauguggcuggauguuagaaauuugaauuuuguugcauuuuugauuugauaauagacugcuuaaaagaaagguuaguacauuuaagcaaauguaauauuuugaaauuauuaaaauguaauuucaugaaauuauuaaaauuuaauaauauaagcuauuacuguuucgcuuauauuuaagcucuaguguuuucuccuuuuagguuuuuauaucauuucagucuaauauuuaaguuuaucauaauaugcuagguacaguuuucagauucauuagcuguugugcacuguuuggaaggaggcaggaaauuuguggcauacuuuguuauucaucauaucaucaagcuguauuucuuuaaaagcacuugcuuuuaggauuuuggcuuuuaggcugugauaguuucugauuuuuuauguaguucuuaucaguguuuuucauuugguaaguuagcaugguuuaggaauaaaaagaaauggccucuauucuuugcuucucuguuuauuggucugguuauuaaacuggggacuuaaucuaaauuuguuaguucaucuguaagauuguuaaacacaugaaauggaucagucuaggaaguauauaauucuaagggauuuaauauuuguauuuaucaagaaauucaguuuuuucuuuuacagucuaugauaaaacuggaauguuaauuuguucugggucuuaauuugcucuucucuuucuuuucucgaguuuugguuuacuguauguaugcuuuuuauuuuauuuuauuuuauuuuacuuuaaguucugggauacaugugcugaacgugcagguuuauuacauagguauacacgugccauggugguuugcugcaccuaucaacccgucaucuagguuuuaagcuucacaugcauuagguguuuguccuaaugcuaucccuccacuuuccccucacuccccaucaggccccagugugugauguuccccucccugcguccauguauucugauuguucaacucccacuuaugagcaagaacaugcggcguuugauuuucuguuccuguguuaguuugcugaggaugaugguuuccagcuuuauccaugucccgguaaaggacaugaacccauucuuuuuuauggcugcauaauauuccaugguguauuaugugccacauuuucuuuauccaaucugucauugaugggcauuugaguugguucuaaguuuuugcuauuauaaauagugcugcaauaaacauaaugugugcauguacacuuuuuaaaguuauaaaaaguucucuaagcugcuaucccaagccauugcaaauagcaaccaguauuagagaaaugaucugcuguugcaaucaaauggcuuuucuuguagggaagacugagaagaugugauuaaaacauucugucaaagugguugauggggaaagcugguggggaggggagauaaaagaaaaaccguguagcuauuaauucucuuauaugaacauaaugaauaaaaugccagggauuacaaggcagagaaaccagaaagaguagcucagauccuucugucuaauauggcaauacuagcgagguuaaccaagguauuucuuuuuaguugagucaaaaagcccaggaagagugaauugaaaguuuguggucaaagcagaaagcaguucuuuuaacuugagaaaaucugaugacuggggacaaacuaguggaaaagccuuuucacauuaaacuaaaagaaguuaaauugauuaagaggauauuacagauugauggggaaguuaugguauguugcucuuguguuuuaaauuucuaaaauugccauuuugcuuuguaguugacguuuugagcccagcuguuuuaauaaaucacuuuauuuaagauaaugaaagaaggaaaaccauguuuuacacuguccauguuuagacuggugauuucuggccacugccaaguguuuugauaaauguagacuguuaacuggagugugcacucauuugugcccuaccauagcguaggcauuauuauuuguuguguuauaucugguccaaaucauacauguguuauccucuggaagcuaucaucauuugaguuugcaauuuccgguuaguuuugaccagaacucgaauguuuuauucuguaguaugguaaucauugccuuuggagugcaggaacaguaagggacuccuguugacuuaaauucaacaacugggacagugggauguugacaccugccuggcagagaccaccagggacucaccugcaguuaaacaguuuguguuuauuacuucauggugagcaaaaacucauauuauugggauucaugagggucgcagaagguguaaaaaaaaaauacaggauuugggcuuuugcuuggugauugggaagguuucagaaaauaacgguuugccguggaugggaugcugucaagaagugggguaauucuaugauuggguaucuuaauguuaucuauagagaaguugauuagaguagaacuaaagcuguaaucaguaaacaauacaucagucacuuauuaucugggaaaaggugcuguuugguauuuuuuggcuuggacaauaucauguuuugucuuuuuucagacaugauuauaaauguguuuuugucuugauauaucaugguuacagaauggauuggugugauauugauguucugugaaauaguuuuguucagcaggagaacacugaggccuccaucugaaugccagggcuuguuuguauuaagaccaaggacuagugauaguaccaggccagcuccuaggugucagaagggguuuucucuuucucagaaguaaagagagagaguucuucuguaacugagagugauuugaagaagacauuuguguuuugugauaucuaaucuagagcuucauuucacauuggagcagcagucuuuuuuuuuuuuuuuuuuuuuuuuuauaagaggcggugucuugcucuguuuguuucccaggcuggaguacaguggcaugaucauagcucacugcaucccgaacucuuggacucaagggaggcuucccccucauccuccugaguagcugggacuacaggugugcaccaccaugcucggcuauuuuuuuuuuuuuuuuuuuuaagagaugggguuuugccauguugcccaggcuggucuugaacuccuuguccucaaacaguacuccgaauaccuuggccucccaaaguagugggaauacaggcgugagccaccaugccuggccagcagaauuuuguuacuaaagaaguauacgucaaagaagaagcauuauuuauugaagucgugauaauuagaaaagaacagauaguugacagagaauuaagaaguaaauugugauaaaauucagucugugugugcgugugugugugcgcgcgcgugcguguguguaugugugaguugagacagaaucuccgucacccaggcugcaguacaguggugcgaucucagcguacugcagucuccaccucccagguucaagcaauucuuguaccucagccucccaaguagcugagacuacaggugcaggccaccauaucuggcuaauuuuuuuugguauuuucaguuuacacggguuuucgccauguuggccaggcuggccucgaaauugugaccucaaaugaucugcccaccucagccuuccaaagugcugguauuacaugcgugagccacugcacccugccccuguguacuuuaucuguaaggauaaaaugagccaucuuuggagaguagguaacacaguuguugaggguaggccuugagcaaaaacuugaagccaugugaauaacuaagguaaggauguaccagaagcuauuuuguaaggugugagcgucuauagcaugugugaggacuguucccgggguaacuaaaacagugugagcaagaugggagugcaauaggaauagaagccagggagguggggauuuacaggagcagcuaaugaagagccuuggaggcauuuguaugcacuuugacauuuaccgucaguagaauagagucacuuggaaaguuuugaauagauaauucagagcaugaugugacuuguguuuaaguuuaaucugucuauauauauauauagacaggaacugugggcaugugggugaaaaacaaccaguucaaaugcuguuucagucaucugaggugauagugauggacauagugagaugaggacagccccuggauaugcuugaagguggaaucaauagcaguauaugacggaucggaugugggaugugagagaagagucaaggaugcccucagugauuuuggucaugcccuuggaaggacagaguugccaucaguugagauguggaaaucugugggaguuguaauuuuuaauagaaaaaaucaggagcucaguuuuuuugagaucuaguuguucauaggggucuggaguuuaguaaagagaaaaacugugcuagagauaaauauuugggaguugucaccauauggauauuuaaagccugagauuagaugcauucgccaagggcaugauugucaauaaaaagaaggcuaaagaaugagcccugguugggcaaucaggagaaggaaauaaaggguauucaguuaggaaaagaggaagucaaauugucccuguuugcagaugacaugauuguauaucuggaagaccccaucgucucagcccaaaaucuccuuaagcugauaagcaacuucagcaaagucucaggauacaaaaucaaugugcaaaaaucacaggcauucuuauacaccaguaacagacaaacagccaaaucaugagugaacucccauucacaauugcuucaaagggaauaaaauaccuaggaauccaacuuacaagggacgugaaggaccucuucaaggagaacuacaaaccacuacucaaugaaauaaaagagcauacaaacaaauggaagaacauuccaugcucauggguaggaagaaucaauaucgugaaaauggccauacugcccaagguaauuuauagauucaauaccauccccaucaagcuaccaaugacuuucuucacagaauugcaaaaaaaacuaaaguucauauggaaccaaaaaagagcccgcaucgccaagucaauccuaagagaaaagaacaaagcuggaggcaucacgcuaccugacuucaaacuacacuacaaggcuacaguaacuaaaacagcauaguacugauaccaaaacagagauaaagaccaauggaacagaacagagcccucagaaauaaugccacauaccuacaacuaucugaucuuugacaaaccugacaaaaacaagcaauggggaaagaauucccuacuuaauaaauggugcugggaaaacuggcuagccauauguagaaagcugaaacuggaucccuuccuuacaccuuauacgaaaauuaauucacgauggauuaaagacuuacauguuagaccuaaaaccauaaaaacccuagaagaaaaccuaggcaauaccauucaggacauaggcaugggcaaggacuucaugucuaaaacaccaaaagcaaugacaacaaaagccaaaauugacaaaugggaucuaauuaaacuaaagagcuucugcacagcaaaagaaaccaccaucagagugaacaggcaaccuacagaaugggagaaaauuuuugcaaucuacuuaucugacaaagggcuaauauccagaaucuacaaugaacucaaacaaauuuacaagaaaaaaacaaccccaucaaaaaguaggcaaagcauaugaacagacacuucucaaaagaagacacuuaugcagccaaaaaacacaugaaaaagugcucaucaucacuggccaucagagaaaugcaaaucaaaaccacaaugagauaccaucucacaccaguuagaauggcagucauuaaaaagucaggaaacaacaggugcuggagaggauguggagaaauaggaacacuuuuacacuguuggugggacuguaaacuaguucaaccauuguggaagucaguguggcgauuccuuagggaucuagaauagaaauaccauuugacccagcaaucccauuacuggguauauacccaaaggaugauaaaucaugcugcuauuaagacacaugcacacguauguuuauuguggcacucuucacaauagcaaagacuuggaaccaacgcaaauguccaacaaugauagacuggauuaagaaaauguggcacauauacaccauggaauacugugcagccauaaaaaaugaugaauucauguccuuuguagggacaugggugaagcugaaaaccaucauucucagaaaacuaucacagggacagggaaccaaacacugcauguucucacucauaggugggaauugaacaaugagaacacuugggcacagggaggggaacaucacacaccagggccugucgugggguugggggagcggggaggggauagcguuaggagauauaccuauaccuaauguuaaaugacgaguuaaugggugcagcacaccugcauggcacauguauacauauguaacaaaccugcacguugugcacauguacccuaaaacuuaaaguauaauaaaaaaaaaaaaaagaaugagcccugguuguacccaacauuuaacagaucuggaagaagagaaaaugcaaaagcuacugagaaggaacacuacuaaugggggagaagcuagucaaaugaaaauguuuguuuuccuuauugcauuuuagcuucucaugaaaaaggacugugccuuaaauaucugugguauauagcauagugucugauacuaacacauuugcugaauaacuuugaagauagguaauuucagcuugggauagguugaguuugaggcaugugaacaaaaucuaaugggcauuugaaaauucuuagcagcagcuaaggagggaggugggaacuggagauacagauuuagaaccuacaaauguaugugguaggaacugaagucagacuaaacacauugcuagcaauuuucaaaaguagaaaaccaguguuucaaaacuguuugcuuagggcaaaauuacuacuaugugucugaaagccaguaguaauuuagaauuuguaauuucacaggcauuuguggaauacuuuuuauaaaccacaugcuauggaauaaaguacuuuauaauauaaaaaguaugaaguauucagggccaggcacgguggcucacaccuguaaucccaacacugggaggcugaggugggcggaucacgaggucaggagaucgagaccauccugggugacauggugaaaccccauauauaaaaccccuaauauaaaaaauuagccgggcgugguggcgggcgccuauagucccagcuacuuaggaggcugaggcaggagaauggugugaauacgggaggcggagcuugcagugagcugagaucgcgccacugcacuccagucugggcaacagugugagacuccaucgcuaaauaaauaaauaauuaugaaguauucuuuuguauuugugggagaugauccaagcauuaauuuccacuaaauaauauuaagcuaauaaauacauuuuuauaggaauuaaacacaauauuuguaauuuaaagcucuugaaauuguucuccauaugguauuuuagaucaguagaacauauuauauagucuuaggucuuuuucucuuuagauagacuuuaucauguacuaaaaauacuauaacuccuggaaauaauaucuuuuacuuggcuauuucgaaauacuguauagauuuuaauaacaaccaauaaagaugagauauuuagcuaaauuuuaaaaugaauuugaaugccagugagaacuguauagaauguuuucuugcuccacccaaacauggaauguuuuacuucuuaaaaaguauuaagaauuauguaccacaaccaaauccauuccauguuuucaaggucggaucauuacuugaaaaucagugucauccaccacaucaguagacauauaauuaacucagcaauuccagucuuagguauuuacccaagagaaaugcaaacauuuccacagaaugacuuuaaaaaaauacaaaaauuuucagugcaacuuuuucacaguaauucaaaacucccucugcuuacucuguaacuccacaacuccacauuggcgucugagcaugacauguacccuagaauucuagccccacugccaccaggcacugcuacauguucucccuaggcucugcagcagcagacacugcccuuucauuugaaaaauauuuagucaguucagcaaagggaugcucuuguaauauauuaggagcaucauuucaaugcauccucaauggaaugaucacuuaaaaacaauuguucgucgaagaacugauaaagauuucacuccuaaggaaaaauucaauaauguuaaguauuuuguauguaaaugaaugagagaaaagaagaugguagguaagugaaauucagcaaacauuuguuguacaaagguacaaugugcugaauaguaacauguacuuaaaguggagaauugagucaaucuaaauaaaaccuagcaauaauacaaagaguacacagguacuacaaaguaaacaauuguaaaaaugccauaaaaugcauaauugaacucuuuggagaguuaaauuucauugaguuuagagaucaggauaggcuuucagaagauccuacugguuuugcugggaggaagagcauucuaaguaaaaagaaugucuuguagaucaguguucaguguuaauuuggaggcuuggaauaggauugccaaguuuguuuuaccaguaagaaaauuccugucucccaucuucaaaagaaacaucucccacauuccuauuuuaucaucuuuuuauuaaaaaugacuuuuuuccauucaaaaggggaagaauaaaugauacaaagcuacuaaauuuuaaaacuuagauuaagugaaaaauaaauuaccaaaaucaauguaagaaguagaaaacugaaaagaccagggaaugcaacauuaaaaugaauuaguaguccgaaaaagugccaguuaaaaauucuguguuuagcauuuugaacaaccaccaaacuacuuuccauaguggguauaucaguuugcauucuuaccagcaauguguauaguucccaauuucuugacauccucacaaacacuuguuacuuucgcguauugcauuuauuuguuaggucucguggguccuuagucuuccucucauuacuuccuuagucuuccuuugucguuuuuugaccuugauaguuuugaaaguuauuggccauuuauuugacagaauuuuacuuaauuuggauucguuuggugcuuacuuaugauuaaauucagguuguguguuuuuggcaaguauauguccaaagugauaugauauuguuuuugaguacaucucagauuaguugccacaugaugauguuaacugaugaugccaacuuucaagcaauuuugaagguuaagguggugcuugucagauuucucuacugugaagugaauuuuuccuuuuuaauugccaugugucuuguggaaauaaucuuuugagucucuauuaauacccuguuuuucaucauacuuuuacccacuaguuuuagcaugcauugaugaguuuugacugaaacaguuacuacugugucauuuccuauuuggugguuuugcaucauucauuuuucaucaccugacauucuauauaugauauugugguaaaguuguuuacuuaaaaucauguagugaugaaguugaaagggucugaaaugguucucuaaugacaauccuguuaaucauaucauguuaauggagcaauggaucuuacaaacacaggcuauauaaaauucauuuuuggaaugucuuaaauguuuuuuauuagcauuccuuuagucuagauuagaacagugcuuuuuaaaguugaucuguggaccaaugguaguccacaaauuauuuauuacuuuauuuuggcugugauaauuucaaggaaugaguaaaugcucagaaucuuucacugcaguuugauguuauuccaguuguacaguauuuuguaaguguauuugguccacaacagauuggaaaauuuaaaaaccauaauccuuuaucucauuuggcuggaaaagcacuggucuaggauacuccaaagcugaaaugucuaauagaucucuugaauauaucuaucauaguauucagaaaucacugcauuuuaaagcaguuaucauauuuuuagcaugacauuggguuacgugaagggaaaagguugagaaaaggggaauauaaauauaguuaggaaaaacaggauaggugcaggaaagagaaaauguuucauuaucuuaggguggacagugcugccuucaggcauauccacuggcauaucugauguagacugucuuccucuucuaucugcagcuuuauuuucagcuuugcuuauguauauuaggaaccagcucaaucaagagcccagcauuuaaaaaaacaauccuuggccugugggguggcucaagccuguaaucucagcacuuugggagaucgagguggguggaucaccugaggucaggaguucgagaccagucugaccagcauggugaaaccccgucucuacugaaauacaaaaauuagcugggcaugguggcgggcgccuguaaucucagcuauucaggaggcugaggcaggagaaucacuugaacccaggaggcagagguugcacugagccuaguucgccccacuguacuccagcgugggcaacagaucaagacucccucuuaaaaacaaauaaaaauaaugaaaaacgguccuuuuuuuuuaaagugagagaaacagaaagaauguuaaauguucuacaauuuagguccuuaacaucacauguagaaggcacuaauuuucagaaggaaagaaagguaaaaaccaauuuaaguaauuagcaguuauaaagaggcaaauaaaaggaggaaagauaaagaaauuguugugcaggucauuguuuaguucacauugauguugucaguucaucuaguuccuuguuaauugguauauuacuuuagaaucuggaaggcauauauuauuguuacuguuauuauuuuguccuuuguaauagaucuuuuaauuugaucguuguuuguuuucuaggaauacaggaguuuccagaaaauauaaaaaauuguaaaguuuugacaauuguggaggccaguguaaacccuauuuccaaguaaguucucaggugaauuauaaauuacuuuugugaauaaaacaauuaugaaacuaguagauauuauuguacauauuuuaacaaaaauuuuauaucaaucuuaagucuauacaaaauuucaauuuuagaguuaaaaaguaaucuuuuaaauaaucauucuaaccccauguacuacugagguaaauuugugaucccaaagagauagugagaguguuuugcuccaagucucacagauaguuaaugucagaaaugagaguagaauccacauuuccucacucuguguuauuuacacccuagaggagugucuuugccuucaaaucaggugugugguaccuucaaacuuuugaaaacaaugaaaccaaaaguuucuucacaguuuuaacagaaggcaaaacaacaggaaacagaaacaaaacaauaacaaaaaaagaaaaaacuauaugauugguugcaguguaucagaagauugugaauguccauuuaugauggugaugacuguaaacaaaguuuuccuggcaccaaggcuguuaaguuuuggaaaaauugaauggugaagcaaaagaugacuagaaagaagcauagcaauccagaaccaacauguaaagauuauguauagccucuucauuugaaaauauugcucuaguaucaaauucuagaucuuuacuuguuucauaaucaacaaaaaauagaaguaaagcuaacacacguagguuguuacauggcccuaacgucauucagcuuuaaauguuuuuucuuuucauuugcuuauuauaaaaucguauaaucuuaaaauuauuuaggagccaaauauugaaauugaaaguaaucuaaaccagugguucucaacugggggcucucaugccccagcagacuuuuggcaguuucuggauacauuuuugguuuucacagugggguauuugugugcaugcaugcacacuauuggcaucuaguuuguagagaucaguguuguagcuaaacauccuauagugcacagggcagccuauguacaacaaagaauuauucagcccaaaauuucucugccaagguuuagaaauucuuuucuaguccuuugaauugagaguagauaagacagauuucaagagugccugcugauuucagaguuauacccuaaauauauuuuuauguauuguggcucauucauaguugacuguuuuguucauauuuuacauuauuaaaacaaauauuaccucauuuucuguuuacaaagugaugaagauacauugaaacaaguagguuauuauaaaaggcaaaucuuugaaggggcucucauaaaaguagccacucauaacagaagcgacuguuuucugucuguugggaaaauaucuugugagagucuuagauuuuaauaaaagacugaauuucuuacaugaacuuaacuuaaauucugguauuuuauguaggcucccugauggauuuucucagcuguuaaaccuaacccaguuguaucugaaugaugcuuuucuugaguucuugccagcaaauuuuggcagguaaauuaugguuucuucuaaaacguuuuauuauuagcucuuauaaaguuuacaaaacuauaagcugcuuugguaguacuacucauuacaguuucauaggcucuuuuuaaauuauucccaagcauugugacuuuuauacuuuguuugguggcuuugacuuaauuuuuccaaguaaacaauaaucagugagaguuugaaagaaaaaaaaaguuuucuuagguggccaaaacagggcguuucaaugggguuaauuucuguaugcuugagauacugaaugcuauauucuuagcauucuaaaaugauuuaauaauugauuuaucugucuucuccccuggaaucaaaauucuuaagaaaagagaaucuguuucugggggcgaccucaucaucucccugccacccucaagucucugaguaauuuuuuaaacaaacagaugaauguauaauagauaugcaguuauuacugaguuuaaauuaacuacuagagaaaaugcuagccaacuaaauguuaauuuuguagccaucuuuuaucuaaaaaucauugauguacuugucagauuccucuucuguaucuggcauuugcaucacuuaaucugcucauuuucucucuaguuuuaguggaauguacaucaaugaagugccagaggauuucuccuccuucuuuuguuucauuauuucuucucagagcagcacuuuagaguugcauuauuguucuugaaucuaccaagaguuaauuuuugugagcauuuuugguaaaagguaugaaauucuggaggauugauacuuugggauauucacuuugucgcuuugaaaauguguggaagugcuaacccuuuuccucugaccacaauuuugaggagcaaaaauaagucuuuucuuccuuuguauuuuauguucuguaauuuuuaauauauuacuuugcaauuaguaauuacacaauuacauugcuuccuuuaaaacauuagaauaugaaauuaauuuauuaaauucauugucuuuguccuaaauacaugauuuuuuuuuuguauugcagauuaacuaaacuccaaauauuagagcuuagagaaaaccaguuaaaaauguugccuaaguaaguaaaggugcuauucuuuaaaaaacuuaauuuauaauuuuuaaugauuaagucuuuaaaaauguaaauuuuuauuaccuaaaauguggugcaaauuauuuguaaauccugacuguguggucaucauauuuaauuaaugguguuaaaauauuaaaauguaugugucuguuguuggugcuuaacgugguacuguguugguaaugauuuauagcugucugaaaugcagucuugugugugacauaaaagucaaaauaauaaauauguaaagcccaccucaauacugaauagaaaucagaaaucccagguucgucuacuaaaguucauacacauagugcucauuagaaagauccauaggaucuucaugugaagccugguaacgguagaacuugauugucuggcuauguaguguauuguaaauuagaaaugcgaugauugguucccuaaugauaagcuaacaacaagagauggcaauccaggagcaaaaaaaaagauuuaauuauaaaagaaacaggucuacaaacucgaaauucacuguagucuguggccuuuuauugaccaaauaucuuaaaacacugugaaugcauugcuauaguguuacauuuuaaggguuggcaaacuacagucuaugauuaaaucuggcccacugucaauuuuuguaaacaaguuucguuggaacacagccacauacauucauguacauauugucuguggcuacuuuugcuuuacagugauaaaguaguugucacuacuguaugcaucuguuguugguguuagagugguuaucacugcucuaucacuguaggcccuaaaauuuuuuagguguacaggaccuaaaauauuuacugucuggcccuuuacagaaaaaauuugccaacucauguugaaaucgcaucaucaagauuugcccacccagccugggcaacaaagcgagacccccaucucuauagaaaauuaaaaaauuagccgggcacagcagcauguaacuauagucccagcuacucuggaggcugaggagugaggaucgcuugaguccaagaguuugcacuuguagugugcaaugauuguaccacugcauuccagcauaagaacagagugagacccuggcucaaaacaaacaaacaagcaaacuucucaccucuugagaaggaaaacaucuccaguuaccccaggaguuguucuguuuacucagcuucuaugacacauuuauaucuguuacaguauuugcuggauaauguuaauguaucuguuuuuauuauaugucacucucuucuucccugaccagcauauaaccugcauguaugugcauguguaucuuccccuugguuucccuugauuaucugugaggacagagacugugucuguuuuuuauuccaaaagacaguguuuugaguaauuguucaaugcauggaugaauguuuauagugaugauugugaguauaaguuaaagucaaauuauccauauuaaaauucaaaaagauauguauacauuacagauuugauacucucagugauaguuccuuagcuaaaaaugugacugguuucuaagauauuugaauaacaagauguaaauuguuuacugugauagcuaagccuauaauuacuaugugauaucauaggcaauuaacugauuuuaacaccuuuuagagauucaaauuagacucucagugaauuugcaaauauucuuuucuccuuuuaagauaugauuguagccuuuuuaauacguuuuuauugagguaaaauauguguaaaauuuacugucuuuaccauuuuuauguguacaguucagugguaauaaauacauuuauauucuuuccccuucauucuuuccuccccacuacccuccucagccucugcuaaucaccauucuacucuuaucuucaugagaucuuuuuuuuuuuuuuuugagacggagucucucucugucgcccaggcuugacugcaguggcaugaucucgguucacugcacccuccgccccccaaguuaaggcaauucuuguuucucagccuccagaguggcugggacuauaagcauguaccaccacgucuggcuaauuuuuuguauuuuuaguagagacgggguuuugcuguguuggucagacuggucucgaacuccuggccucaaaugacccgcccuccucggcuucccagagugcugggauuacaggcgugagccaccacacccggcuugggaucuuuuuuuagcucgcacaugugaaugaguacaugcaauauuuaucugucucugcuuggcuuauuucacuuaauguaaugaccuccugaucaacccauguuacugcaggcagccucuuuuauggcugaauaauauuccauuguguauauguaccauacuuuauccauucuucuguugacgguuauuuaaauugauuccauauuuuggcuauugugaauagugcugccauagacauaggaguucagauaacccuucaguguacugauuuccuuucuuuuguauauauacccaauaguggaauugcuggauuaugugauaguucuauuuuuaauuuuuuuuaggaacuucuauacuguucuccauaguggcuauauuaauuuauauucccaccaacaguguucagagauuccucuuuguucccauccuugcuaguuauugccugucuuuuuugauauaagccauuuuaacuagggcaagaugauauuucauuguaguuuucucugauuagugaugaucauuuuuucauaugccuguuugucauuugcacgucuucuuuugagaaaugucuauucagaucucuggugcauuuuacaauagaauuuuuuuuuuuuuuuuugcuauugauuuguugaagcuucuuauauauucuaauuauuaauuccugucagauggauacuuugcaaauauuucucccauucugugguuuguucauuuuguugauuguuuccugugcaguuuuuuagcuugcuguaaucccauuugucuauuuuuguugcuuuuauugccugugguuuugaggucuuacacaaaaaaaucuuugcccaaaccaguauccuugauauuuauauugagaauuagcauucuccaguguuuucuucugguagcuucauaguuucagguguuagauuuaagucuuuguuccauugugguuuaauuuguguguauggugagagauagaggucuaguuuuauuuuucugcauauaguuaucaaguuucccagcaucaauuauugaagaaacugucuuuuccccauuuuaucuucuuggcgccuuuuucuaggaugacuuggcuguaaaugcauggauuuaugucuggguucucaauuccuuuccauuggucugugugccuauauaccaugcuguuuugauuacuauggcuuuguaguacaauuugaagucuaguagugugaugccuucaacuuuguucuuuuugcuuagcaucacugugguuauuuggagucuuuuguugugguucuguauacauuuuaggauuuuaaaaauauuucuguuaagaaugucaguguuuugauagggaugacauugaaucuguacauugcuuuggauaguauugucguuuuaauuauccuaauccaugagcauggaguaucuuuccauuuuuuuguguccucuuuaauuucuuacaucagaguuuuauaguuuuucuuguauagaucuuucacgucuuuacauugauucuuagguauguuauauguauauaccuaagaauaaauugauauauauaauauaauauauauuauauuauauaauauauauuauauauuauauauuauauuauauaauauauauuauauauuauauaauauauauuauauuauauaauauauauuauauauuauauaauauauauuauauuauauaauauauauuauauaauauauauuauauauacauacacacacacauauagauuuuuuuuuauuuauuuuuugugugugugaugaagucuugcucugucacccagguuggagugcaguggcaugaucuuggcucacugcaagcucuaucucccggguccacgccauucuccugccucagccuccugaguagcugggacuacaggcgcccgccacuacuccuggcuaauuuuuguauuuuuaguagagacaggguuucaccauguuagccaggauggucucgaucuccugaccucaugaugcgccugccuuggccucccaaagugcugggauuacaggcgugagccagugcaccuggccgguaugucauauuuuuuguaacuacuauaaaugggaaugcuuucuugauuuuucagauuguuugcuguuggcauauguaaauccuccugauuuucacaugcugauuuuauauccuucaacuuuacuuaauucguuuaucaguucuaacaguuuuuuggugaaguccuuagauuuuucuagguauaagauacauguugucugugaacaagacuaauuuugacuucuuauuuuccaauuuggaugcucuuuauuucuuucucuuuccuaaugguuuuugcuugauuauaacuuugagaccucacaaacaagaggauauaguuuuaaguauuacaaagucaugugcauuuagguuauaugacuauaucaaagauuagagcaauggaaagagcuguuguuuuagauauauaguuaagugaaauuuaaugcuaccuaaagaauacuggagggcacaguacuaagaacacaaaagauguuuuacuuuuccuuugaggagaggagaaagugaaaugaguucaauacaaaugaauuuuagaaacagaugggagaaaauaugagggauauuguuuauguuuucuccuugagagaggcagcuagaucuuauucuaggaugcaguuuuauuucugagauuucuaaaguguaugaguauagccacaguugucaguauuaacuauagagaguugagguggagacucuuuuugacaugacaguauauuuucuuuuuuauuacauaucuguaucacucacguuuuccuaaaauuguuuuaaaauauaaauuuuccaggauaucaucuguaauugaauuuuuccaaugcacaccuuuucauuuuuguacccuuuucuaaaacuguuaugccauugacauuaugugcucaauaguuacaugugaauuuucuguuaucuugucauuauaacaauacugaagcaagaaauguaagauuauguuuuguucuuucagucuucucuuccuccucacaaucuucuucacuuuuugcaaaucuccaccugguauaguuauuugaacauaggaaauuauaaucauagcaugugauuuuauacaucuggagaaagaucguggaagcaaccuuucgcuuguuaaugaaggaagcuagaacuuaaagguuuucuggggaaagauaugaguaaggaagcagaauuaugguaccugagaauaggcacuuaguaaaucuaggugaaagcaguuuuauaaaaauuggcauuaugagaugaauugaagaguugaugacagaauggcauauuuaaaauguaaagggaaaauucgcuucuaauguagaccaaugacaguuucauuacaaugaugguguuuguuuuuauauuuuugacuaaaaagcuggagaaauguugcaacugaguuuuauuuuacuuauuacuaauuuuuguuaaaauuccagagaagauagaaauagucuguguuuuucgugccguaauuugaagugccuguggauuuuaaaugauacucauuuucaaaguauuaacauauuaauguaauauacugauauugugauuauaacuauauuuugcucucauuuugucauauccuacaaaauccuuaauacagaauuucuuaucuggguaacugguuacaucucaauguauuaaauaauagguguuguacaaaaauagccacuuaagaguguaaauauuuguuugaauuaguuucaaaggguaccuuuguaaaaggagagagaaaagauagaagugcaacauaguuuauuucauuacaaacugguuuguacaucuuucaaguuccuguaauuucagagaaguguugauguuaaguuggaaguuaagaauaguauauuauugcuuuuauuuaaaauaaaugucaacuacuaauuugugauucauauaaaacuuuauuuugaauuguauuguauuuaauuugaacauguggggaguaauacaacguacuguuagcauuuugaauauuaauuuucggaguuacaguuaucuuaaagucuuacaaauauaugagcaguuuugaaaaagaauuuuuguaauuaugguaguaauuauuauacaucugccaacauuuauuagcugacuuguacuauaugaaaauucauuaugugaaaaaauagaaacucauuauuuguauucuggcuuguggguuuaaauuuauugcaauugcuucuuaaaaauagaaaugaaaagaccaaugagaaggcaaaauaagauaauaacugauaauuauuuuaucuagaaaucugacuuuuaaaauuuuuuagaaaauuaauauuuuuauuuugucaacaugugaaagcccauaaauaauuaccuauuccauaagaauguuuuagacuguuuugaaagcuuccauguaauugauauuuuucuaguuaauuuuucauuacuccauuaugaacagaacuaugaauagacugacccagcuggaaagacuggauuugggaaguaacgaauucacggaagugguaaguucucaucagucucacuuucccuaaguucuuauauuuaaugaagaacaaaauaugaaaauuaauguauuucucuuacaaauuggauaaagguuuacuuuuuuuucuuaguuacaagauaugaaauuucuuagccagaacuuuccagacagauagaaaaauuaaccagacagaugaacuucugaccacaagugagcauaaaauguaaaaucaaugagagguccauggaagagauacuaaacaauuuuuagcauaggaagcagaaaauuugagugauuauaagugggaaacaucagucuggaaugcagcagguaaaaguaguucugaaucagagagagcuccaugggguauugcuuguuaacuuauucaguaauaagauacuucucuauaauguuacuuaauagcuaaggggaaaaucauugagugaaacaacuguuauuuuugaagugguaaugagaaccuuuuuguuugugcuuuguaugccaagugcgcuaugaagcugacucuaaaaggaaaggaguaguguuuaaguagcuuuugucuuuagugaguuuuccaaaagaacucagaaaauaagcuagauuuuuuuuuuuuugaagaggaacucauccagcugaguaucauuauuaaacuuuuaaauuaguuuacaaguuuguuguuuaaaagugugguagcucucaaaugaugguuuuaagccuaggaauuucucaaaacugcuugcuauaguauugcccuguggguauuauauuaauauuauaaauuucagcugagguuugaggaggaacaugguacuuuggaguaccucauucucuaaaauacaugcugugcuucccaaauuauuuaucuguuacguccuuucucaauauuuguucuguaugaauccguuuccguauuaacuauuucaaaaaucucguucauuuuaagaauccaacaagcuuucaaaaucgucauuaguuuuuguaccauuuuggucuuccaacauuauacacuuuuuaaaacuuacaguagaauuuaacaguaaugcacaaaaggaaauuucuuuuaauccaaguuacaucugggauucuuaucuauauuuauauguuaacaguaaaucugauuggcaugccuuuuauauaugacuguuaacuauggucauuagaugugauaguacucugugccaucacaugaucauugauugcagauggcuuugugaggugauagaaauaacuuugaagagggcagacuugaagggacaaugcccaggagcaaauuuugccuggauaugaaggucugccacaacacuuggauuaauuuugauguccucaacaccauauuauaaagaauuuucuaccauguaauuagaaguuuuuacuagagguuuaaauuacaguauauuuguaucauguaguuaugacuuugucuauuuaccuuucccugauuauggacauuuaggaugcacguugucuuuuaucuccuucuuaaugaaugucaccagggaacauuuguaauuuuucuguuuucuaaaagcuguaucuucuuacugauaaugcaugagugcauauuuuuauuguauacuucuaagcagugaguccuauuuuuuauuucuuuacaaauuauauaaaaacuugccccuguuguguaauccaaagcuuaaauguguuuuuuguaaucuacugcuauggcaugucucuuugauuucuccauuaauaauuuucuauaauaauuuuacuguaguaacuauaaugcaguagaaaggcuuacauccuggcucuucuuuuuuauuuuuccuucucccugcuccuuuuauuuaaugauuugaaacuaaagguuauuagaaauucccagggcuucuuuugccagauaaagacauucauaaaaauuaauugaauuacugcuauccccuacccuaaucccaacagccugaaguacuugagcaacuaaguggauugaaagaguuuuggauggaugcuaauagacugacuuuuauuccagggguauguauaugagauuuuaaauggcaucacuuauuucuggcucuccuuugcaguuuugugaauuguaccuuuuauaauuacuuuuaauuaauaaaaaaauugaauuauucuuuauuaaacagaagcaaauuacuuuuuuucaugagcacauucuugauuauaaucuaagaauucucauaauaaacauuuguaugucuccuuuuaauacuguugaguguguccuuuccaaugguaucacuugaacuuacgucccaauuugcuuugcccaaggaauugguaaacuaggauauuuuucaugaacuuucugaauuuuuuuuuuuuuuuuuuuugagacagagucucgcucuguugcccaggcuggagugcaguggugcgaucucggcucacugcgagcuccgccuccuggguucacaccauucuccugccucagccuccugaguagcugggacuacaggugaccaccaccaugcccagcuaauuuuuuuuuauuuuuuaguggagacgggauuucaccguguuagccaggauggucucgaucuccugaccucauuauccgccugccucggccuaccaaagugcugggauuacaggcgugagccaccgcgcccagccgaacuuucuguuuuaacaacugacaaauuguuuacucccauaaaaaaaaccacaagaauccccauauaugcuauuuccuuaggagguaauggauaccugaauucccaaagaauauguccuuugucacuucugcuaugcuacaauuaguagaacaucuuagcuauauuacugaauacauuucuaauggcauuuaaaaaacuaccugggagucuucuuucuuguauuagcauuuaauuuugaauuaaaacuugguaucaaguuuauucccuaaacuuuuuacaaauuacuaauguuaauagagucauuagauuuucuuuuuuuacuuauaguuuauugguaguuugaaacagcucacauauuuggauguuucuaaaaauaauauugaaaugguugaagaaggaauuucaacaugugaaaaccuucaagaccuccuauuaucaagcaauucacuucagcagcuuccugagacuauugguuuguauugcuuucaaauucauguaauuuuuauuaaaauaaauucgagacuuccacauaaucucaaauuucacuuguuaugagguaguuauacuucguuaccacaggaacggauuuuauuugaauuuuuccuggugugaucaguuguacaguuugcuccuuuguugacauuacuguuuuuuauuuacucuaagguaaucucauuuuuauuucuaauauauuuaaauucuuuaaaauaaguuaacuuaugcaaauuuggcuuaacuguuagcuuuuauugucauagcuuuuauuuugguaacuuuuuucaguccuguuucauuacagacacucagacaagaaaacagaucaguugaacagaucaugagagaucuaugauugagucuguguaguugcuuguucaaugauaugucaauggaauugaauuauuuugaugaaaggacccaaaacuucaaucuugacaucuuuuugauguuuuaauuuaaaaaccaaaaauauuucucaguuaaaucacguagugguuuuagcuaaaacuacauuuuuguaaguuuguuacgauucuacucuuagucaacacuuuuuaaacuuaaaaaauauuuuacuguuuuaguauuuaguauauauggaauaguuuuuuauauaccuguuaugaacuaccuucauacuaccauuucuuuagucuauuaauuuaacaaguuuguauugucugucuuuucugugccaugacauuguuuuuagaagcagagcuacaacagugaacaacgaagacaaaaaaguuccuacuaucaguauauuuuagugggaguuaauaaacaaauguacacuauguuaaauagugauguggaugaagauugaaaggacaggaugagggaauagaacauugggauugggagugguaucucuuuuagauacguuuguuaggaaaguuguuucuaauucuugucagauguaguaugucucacacugacuguugguggacuugcuucuauuuuaagcugaaaaauuguauguuguuucuucccucauuagguucguugaagaauauaacaacgcuuaaaauagaugaaaaccaguuaauguaucugccagacucuauaggaggguaaguuuuuugugaauguauacacccucgaagauuuuacuuucaguucagcaugccauacauauuuucagguauuugcauaaaugaccuaaagauuuuguaaacauuuaaguaauuaguauacagguugaguguguuuaugauagacaaaccuacuuauuggugaaguuuagcuuugugaaaugguuucacuagguuuucaaagucaaguucaaauguuuauauguucugaaauuuuggauuauauauaggaaaucuuuaacaaauaauauauauuucuuuuuuuaaauuaaagguuaauaucaguagaagaacuggauuguaguuucaaugaaguugaagcuuugccuucaucuauugggcagcuuacuaacuuaagaacuuuugcugcugaucauaauuacuuacagcaguugcccccagagguaauguauuuuagauuuguuuagauuuuugucuuuucauuuuuuucugauuaucuucauuauagcuauuuaguguggcuucauuuauuuucuuucuaaaauaguuuucaaguuauuuauuuucugaauaauuagcuauguuaauuuagaagagguucuuaaaugcuuucuuauguacauaaaaauuaauuaaaaagaaagucuagucauuauuucuucuauaaaugugaaguauuuuucauaacuuucaaaaaugauguuuuuuauauguugaucaaccuguaggccaaauuuuuugauacucaguuuauauuucucuuucagauuggaagcuggaaaaauauaacugugcuguuucuccauuccaauaaacuugagacacuuccagaggaaaugggugauaugcaaaaauuaaaagucauuaauuuaagugauaauagguucguaauacuauauucaucaguugguuuauaggagacauugguuagaugaaauuaaguuucauaugauauauaauagaauagcuagugcuuguugcucuuuaaauauacauaguaaguucucaguguuauugauaggcucuuggaaagugugacuuucagugaaacaacauacaaugaaaucacuucuuucguucaucaguguuauaagaaaaugacauuauuugagaaccugccauacacaguuuugcuaaaaguuuugguuuccaagaaccuaucaauaacuuaaaugaggacuuaacuguauauauuuuuuucuuuaaauacaaagaguggucuuauuuuaucugauguuaauuuaucauacggugguuguuacuguucauuuuggguugacuuagcuauauagucuuuauucucuucuuacaguuaccuuuuauuucugaagucacaucuucaccugaauauugcuauuuaacaaaacaauuuuggaauguaucuagucuguugcuaauauuuuccuaggcagagaucugguuucaacaaagccaaggugcagaguaaauugaucacuaggguuguaaauuggaacaauguuuaaguuaaaaacagaauguccauacuuuuucgugagguaaacauacuaaugaugauuaaacagcauuuguagaguguuuucacuuuuugcuuucauagugucuugugaagucuucaaaacagcucuaugaaauaguauaauaguauucccauuuuauguaggaggguuuuaagacucagauuuaaggugacucacguagcuuguaagguagagcuuuaauuuaaacucaauuuucugacuaauuaugauauucuaacuucuguuuuauuuaaaagaaccacugcuuucuuaagucacguuucagccuuuaauuccuacggcccacaguggguugcugaaagaaaggcacggaagacuaguuagguauaagauagcaaggcugaaguagauaauucucucuuaaauaagauauuuucauuuaguauucuaaugaguauuuauaguugacccuuguauuuguggguucugcaaguguggauucaaacaacuucagaucagaaauauuuggaaaaaaauugugucaguacugaacguguaccaacuuucccauuguuauucccuaaacaauacaguauaccuacuauuuacauagcauuuauauuuuaauagguauuauaaguacucuagaaaugauuuaaaauauauggggggaugugcauagguuauaugcaaauacuauacaauuuuauauaagggauuugagcaucugcagauuuugguaucugagggagauccugggaccagucuuccacagauacugaggaaugacuguacuuuguuuuuaaucauuaucaucuuaggguagucuucuagauuauguaacugcuggcucacaaauagagagcagugcaguuuuuauagcaaacuaucacuaagaguguuuccuauaacaguuuguucucccuaaguacaaauaaaccaaagcaauguuaugagacauuccuuaauguguucuuuucucuaaggcagggacaauuaauuuuucaacagauuuuuaagguuauucuauuauccauuuucuuaccaggugaauugauucaauugaagaauuauauuuuugaaacuaauucuuauaaaacuagauauuuuguuuuauguccuauacgaagaauuauauuggacuuuucucgauuuuuuuuucuccuauuuucaugugcaacuauauagcauuuuucagaaaaccuuuagguugaacccucauucauuuuaaaucuucucauuuuaaaguuuaauuuuuguuuguauuuuuuuccuacagauuaaagaauuuacccuuuagcuuuacaaagcuacagcaauugacagcuauguggcucucagauaaucaggugggcauucugauuuuauaaguuaauggaguucuuauuuguguuauauaguuuugcacuccgauuuacauagggucauuuaagagcagcuauacaugugguacacauguaaacauaucuuuuauauaagaaaaaucucaaaauauuuagaagcagauacuuuuuauaaaauagguguagauuuauaaguaaugaauuauguuggacuugccuaauuucuccuaaaucuguuaaaauauugagcgauuaggaaaucagacucaaacucugaauuuaauagcauuaucucauacacuugccuauuuuauagugagaacacuuaaagucuacucggcaauuucaagacuauaacaguguuauuaacuguagucaccauguuguacaguagagcucuugaacuuauuccuccuaacuuaaauuuuguacccuuugaccaauauaucccaauccauguuccagcccaccccgccagccccagaauccaccauuuuacucuuaguuucuaugaguuuaucuuuuuuagauuccucauauaagugaagacaugugaaguuuaucuucuuguuccugcuuauuucacuuaacauaauguccucuagguucauccauguuguugcaagugacaggauuuccuucuuuuuuaaggcugaauaguauuccauugugauuguauguguauuuguguacacacacuacauuuucuuuguucauucauccauucaugggcucuuaggcugauuugcuauugugaauucugcugcagugaacaugggagugcagacaucucuucaacauacugauuuuauuucuuuuggauauauauccaguagugagauugcuggauuauaugauaguuccauuuuaaauauuuugaggaaccuccauaauauauucccaccaacaguguguaaggauuccuuguaaguuuuucuaacaaaauagaauguacaauuuacugaucuuuugaauuaaaaaauuaaugcuuauuauuugauguugagcaauauuuuauaauaauuuauuuaaagcuguauuuucccaguguuggguacacuggucucauaugauacucaugaacuccgcagccaaauuuucuugggaaacuauauuauauucuaauucuggauuauauuaacagcccugagguguuaauacaguaaagaaacccgcaaggauucuucauaguuuuuaacuggguacccuuuucuguucuguucuguucuguucuguccuguccuguccuguccuguccugucuuguccuguccuuuucuuuuuuuugagacagagucucgcucugccgccaggcuggagugcagugacgugaccucagcucacugcaaccuccaccuccuggguucaagcgauucucuugccucagccucccgaguagcugggacuacaggcaugugccgccacucccagcuaauuuuuuuauuuuuaguagaaacagggccaggauggucucgaucucuugaccucaugauccgcuuguguuggccucccaaaagugcugggauuacaggcgugagccaccacacccugccuugggguccuguuucuuaccuagccauuacuaauaucccagaagccuuaaauuuauguuaauccaugguuaugaauaagacauuauuuaccugcuuugcaaauuuagagaggaaauauuaaaaugauacauugccuuuauuagaguuuuguuuuuguuuuuguuuuuugacagagucuugcucugucacccaggcuggagugcaguggcaugaucuuggcucacugcaaccucugugcccccgggcucaagcaauucuccugccucagccuccugaguagcugggauuacagguguaugccaccacgcccggcuaauuuuuguauuuuuuuuaguagagaugggguuucaccauguuggccaggcuggucuggaacuccugaccucagguaauccgccugcuucggccucccaaagugcugggauuacaggugugagccaccacgcccagcuuuacuggagcuuuuuaacacaggcaauuaccguaucuguuauauguggaacugauuucucuuaauugaauaguauauguuuaaacgauuugaaauuuugcgacuagauucagaaaaauuugcuggaccccaucuuaugccauuuacuaacuucacaaugaaugagacauaccuccuggucucgaggaacucuuagacuaauucuauuaguacaguagcaccuuuuuuuuuuuuuuuuuugcggcggggucuuacucugucaucuaggcuggaauacagugguauaauuaagacucacuggaaucuucaccuccugggcucaagcaauccucccaccucagcuucccaaguagcugggaccacagguacaugucaccaugcccagcuaaauuuuuuuuuuuaacguuuuuaguagcgacaagaucucaugauauugcccaggcuggucuugaacuccuggacucaagccaucccccugcuucagccucccacagugccgggacuacagguguuaaccaccaugccuggccugcaguagcacuucuguggauaaauuaaugccagcaaauuauaccagaugguucauuuuaaugaaauuaaccaaguaucugcuacgguuucuucauauuuauaguguucucucauucuauucucacucuccacuugguuuaaaacaaaaauuguaugguaggagucuuuguucuucaaaguuugacagaauauugaguaaaacaaaucagauauaccuagaaaauuucccuuacccuuaccauaugaagcaauaauuuugcuaugaaagaaugacauguagaggagaagguauacagagguuugguugugaauuauaaaaguaaauuguucuacuauuuaauguuuaugaaaauaaauugcucagcuauguagaacaguacaugcaguaauauaauuuucaugagcugcugaaggcaugagcagaacaauuauuuauuaauuuauucccucauccauuuugugauucucaggaaccauuuauugaacaacugcuuugugccaggcaauuuaaggugggaacaauauuuagaaaguuacuuuaauacaaugugguuaaaagacuuaauaggacuaagcuuuaggaucaaagauggggaagauaaccaagggauguaaaggcaaauuucucagaggaggaaaugccugcagugccugaauuaucucucaaaagaggaacggggcuggguauggugguucacaccucugaucccagagcuuugggaagcugaggugggaggaucuuuugaggcccgaguuugagaccaaccugggaaacauagcaagauuccgucucugcaaauaaauuaaaacauuagccaggugggguagcacaugccuguaguccaggcuacucaggaggcugaggcuggaggauccuuugagcccaggaguucuagguuauagugagcuaugagcaugccacuauacuccagcaugggcaacagagcaagauucuaucuccaagauaguuuuuuuaaauaaaaaagaggaauaggauuuuugucuauuuuuuaccccuuaaggugggguuuuccuguguugcccagucugaucucaaacuuccagucucaagugaucuucccaccccagccuccugaguaucugggauuauaggccugcaccaccaugaccaacuagacauaagauuuaaagaaaaaaaaagagaacaguguucugguuuggaagaauaucaugagcauaagcauuuaggugcaaagcagcauaguauauuccauaacucuacaagcagaucauugugacaagaguguaacagugagacggaaaagguagaaaacgaggcuacuaaggcagauagagaucaguugguggaggaucuucuaugccaugcagaggaaccuguauuauaucucaaggauggcaaauaagauuuuuuaaaaucuuguacucuuaucaauuaugaguggcuuccugaaaaauuguguugcagauucugacuuaugaucaaauucaagcuaguggaaaauugcugugauuuggguggcuguguaguuuauugucccuaauaggacacuuucgggggagugaaaggggcaccauugauaauuacaugagaacaacauguauaaguugugucugucucaggcaaaauggacauuuguucauucuagucaugaucaauuauucauaucugccaucaguauaaaaggaagaagugauuuuuaugauagauaauacggaaaccaguguaacauugaacaggcaaauaguaugaucacacugauauuuuagaaaggccuuuuuggcugcaugguggaagauggauucaucagggguuagugccaagcaugaagguaggggagacugaauuggaggacauugucauacucuaggcaacagaacacguugccuugaacuaaaguaaugaaacagaacugggggaagagcagguauuuuugaggaauaguuuaaaagauugcaucaauagagcaugaagcaaugcauguaugugagaagagaguaaaagcaaagaugagggucaaagauuuggcuucagugacuagguggauaauacugccacaaccaagaaaaguaaccacaaaugaaagaaauauguuuaugggaagaugcuaaguucuaguuaaacauguugaguuagaaguaucuuugguauauccaaguuagccaugcauagaacacgcuggugaccaugaaccuccugacuucauuuucuucuguaugguuucugugcucuugguuucucuauuuaaaaauuucuaaccuucagaagcuucucaaaauugcuccugaaggcuucauuuucuuuuuucaguacuauuauagguuuauucuuugugcuuauuuguaaaaauauauucacuuuauuuuaaaagauuuguggcacaagaagaaauacacauuuguuucagcccaugaucguaauuaacuuuuucuagggaauggugucauagcuuuuguuguuucucaaaaggaauuauauaaaauaacuuuuaaaauguuagugaugcaugaugaauccugaggaaccccaacauuuaaauggcaguagacuaagaggcuuaaagagaguagccauagaaguagaaggagaacuggaugaugauggacucaaguuaagagugaagaaggaagaguuaagacuggccugaaggaagaaguuguuaauaggauaaaugcuguugagaagucaguucagauuauaucugaaaaauauccauuauauuuggcagcuagcuaaaguaauuauagagguauauggcaaaacccagauugaaggaguuuaaggaauaaauagaugaugaaauggaaucacauaauguugauuacucuuuaagaagguuggaugagaaggaaauggaauggaacauaaagaaauugauagcuagcagcaggaaaagcgcagggauccuuuaauauugcagagcauguuuacagguuguuggaaagaagcugugugaguaagauuaagaauaugagggucuggugcggugguucaugccuguagucccaacacuuugggaggccgaggcggguggaucaccugaggucaggaauucaagaccagccugaccaauauggggaaaucccgucucuacugaaaauacaaaaauuagccgggcgugguggcgugugccuguagccccagcuacucgggaggcugagacaggagaauugauugaacccaggaggcggacguugcagugagccgagaucacuccacugcacuccacacuguagccugggugacagagcgagacuuugucucaaaaaaaaaaaaaaagaauaugagaagcaguuggauaauggauggaaacugauggaaaagcuaugacaggaauucuuaaccuguuggagagagcuuggguaugacguuugugaaagggaggagaggaaauaguguacauuaugauacucuuagaauguagaauuuuccauacucauagcuguuuuuuuuuuuaagacagagucucacucugucgcccaggcuggggugcaguggcuccaucuuggcucucugcaaccucugccuccuggguccaggcaauuuuccugccucagccucuugaguaguugggacuaaaggcacuuaucaccacacccagcuuuuuguauuuuuaguagagacggaguuucaccauguuggccaggcuguuauugaacuccugacuucaugugauccacccaccucggccucccaaagugcugggauuacaggcgugagccaccaagcacaaccucauagcuguucuugaauccuuuuuuuuuuuuuuaaggaagauauuuucagaacacaguuuaggaaacauagaaggauuuucagguaacauguagagccuaguugaaguauuauuaguaucaguacacaaauaugaguacaaauuaaucacuccacaaguuuguggugauacuaauuugcucagcaauguaauauagagaaagcacacaacuggaaggauuuugggcuguaguuuugccaagacaggugcaagaaaagaauaaugcagcaaagaggucuugguuuguggcaagaaagugguuuaaauaagauacagugugguacaaaaggggagucaaagacaggaguaaauggugggaagaaugucaaaaggucaaaggaauaguagucuugcugagggugaucagcaaguacugugagugcaguggagugggagggcugcaugaugucuguguuaccauacucugcugguuguccuuuuaccugacugcuccucagucuccuuuucagacauauuuguucugccugugccuuacauguuugugcuucucaugguuacccuaggcucugcuuuaauuucucccuacuuucuccugaaauugcuaucuguauccucauuauucuuaacaauaucuucagcccaguucuugugccagagcuucacauucauauagcucaauuccuacuuaacauugccaccuacaugucucaaauucagcaagcccaaaauugaguauaccacguucugccccaaauauauuucccccacaccccucagcuucuuuagcuugguaaauaauacuugauggaggcagaggccuggaaaugcaacccuuaacuacuguuuuucccuguacuucaguccaguugauagacaagcccuauugaaucuuaaacauccuaguguuuguguauuuugcuuuaucccuacuaccacuucccuuaaauacuguucacugucaucuuucacuuagaccugcacuguccaguaccauagccacuagugucaggugacugguccaaauugagauuuggugugaguguaagguacacacugguauuuguagccuuaguaugaacagauaauauauauggucauauuccuaauuuuuuucgauuauauguuaaaaugauauuuugaauauguaaaguuaaaugcauuaucaaaauuucaucuuuuuugccauuuuauuauauguggcuacuaaaaaauuauaaguaaucagacugggcgugguggcuuacaccuguaauccuagcacuuugagaagucaaggcaggaggcuugcuugaggccgggaguuugagaccugccugggugacauaacaagaucccaucucuuagaaaaagaaauagccaggcacaguggcacauaccuguaguaccagcuccuugggaggcugaggcgggaggauugcuugagcccagaaguucuagguuacaaugagcuaugaucaugccacugcacuccagccuccagccugggugacagaacaagauucucuuaaaaagaaaagaaaaagaaaauuauaaauaaucugugguacucauuuuugucuuaccuuacagugcuuucgaacagugcugacagacuguugagguagcuuccuaauaggucucugccuccaguguugcuaccaguuccaaucccuuauuacccauucugaaccacauugugauuugagugauucuuuaaucugaucccagcacuauccuacuuaaaaccuuuucauuguuucuuuuuucuuuaugucauaugccucaagagccugcucaucuuguggcuucaucucuaccccauacacauucauucucauuucucuaaaucaguucugcuuucuuggaacauucuuccuucucuuucuuaccuggcuucuuaccuucuuauccucaccuuagacuuucuuucaggaaugcuuugcuaaucauucaagauagugguaagugaauuucuccuccuguauguucuucuugcacacuguacccugucuacccuguaauuucacuuggaauuacaguagcaguugccuauuuuguuaccuguauucuuccucucauaaacucuacaguaaagucaguaaagauacaugcuuugcucaccacucuguacacaggaccugucauagugcuuugcaauauaaaaggcucuuaggaaauauucauugaaugagugaucuuuauauuucagagaagaauauuuuaggaauuauggcauaguaauagaauaugugaaaugaaaucggauuaaagaucucugaaguuagguguucagggaacugagaggccagauauacuguucucauuccuuuuucugucugugccucauaaauaacaggugacuaguuuucuuauuacaucuuuguugacauguaauucauguaccauacagugaaccccuuuuaaaggauacaauucagugguuuuuaguauagucacagaguugugcaacaauuacaacaguuuuagaagauuuucagggugaugaguuuuuaaaagccucccauauaauuuuuauaugcucaucuaagggggcuuauuuuuuucuucucacaaauuguucaucugcuaagaagccaaaaguauggaaaugucauauguguuuuguauauguugaauuacucgugacuuuggaaaaauuugguguaaaagagccaggaauagaugaauaccaccaagaggccaguagauaauaggacaggagauugacuauggaagguauggguuauaugccucaaaggaaaaggaauuuaaaucugaggauaagggaggaaugaugucacagcauuguaagcgcuacccucaccuccugacuugggguggaugagguaggagagaauaaaacaccuguauuugaggccugagagaagcacugucuuugggaagggaguagagcuaccguuuccauuaucugagaguuaaggaaauuguucaggaauuugaaauguagggcagauuuuguuugcugaggaacagaaaggaauguuuaaaugggaguaagauuacaggauggaauuaacuagcuggaagguuuucauaggaguaggugcaaagaauuaaguaauagggugacaugugaggggagaauuggguaguucucuguccgucuggagucagccaaggcuuuuauugguaggauuuuaggugaauagcaaaaagaauuaguuauauuaaaaaauagauggauaacauuuguugacuaguuagggaaaaaaucauaagaaaaaagaagguccaaauuuccugggggacuccaccaccgagugacuuacuggugucauuacuguagacaggauacacaagaggaagaaaaagaagcagcugauuguuuucaucauucucuuuucagcugcuaacuagaauaaacauuuagauaaccagacuaacuguuccacauuuuuuccaaaagcaucuuagugaaggggaauacuagagagggcaaaauaauauacaauggaaaggcuuauuuuauaacuguauuaaauauaucacuguguuaauaaguaacggacuauggauaaacuuaguauaugaaaucuuuuaaaacgauauuucaguagcuugauuuacuugcuuuauacuaaaaacuacauuuguuggauuuuaauaugguuucaaaucaaugccuaaaguguuaucaaaucaaugccuaaaguguuauuguguauaguuagauuuguuuguaaccugcacauugauacuuuauagaaaaagugguguguacuuaugcagaggaauugcugaauauauauuugcuuuaggguuauugaaaauuaagcauuuauuuuccuucucuaguccaaaccccugauaccucuucaaaaagaaacugauucagagacccagaaaauggugcuuaccaacuacauguucccucaacagccaaggacugaggaugguaggaauuucauaaucgauuuucuuguuaaaaacaaauacuaauuuaaaaggugugaagugaacuuuaagucucagagacuuuuaccaguuugaugggacuucagagaauugaccaaaacaguuuguuucgaaauaauggaaaaauagggcacgauuucagggguugaauuuagaaguauaaguguagcauaugcuuccuuaaaugauuccuuuaaauuaaaccgcaguguuaaaauugauaacuuaaaaacauuuagcuguaugcuaggaauacauguuaaguguuaugugauaagaauuauuaaaccaagaaauauuuucuucaccugugaacuuaauauuacacuuggaucuacacacuggaucaggauaaucuguugaacucugacuauaaauacuacucuuaaauucuuuucuuuauuuugcccgacaagggggaguauaccuuuuacuacugggcacagauguuuuuauagauuaugguaugacgaccuuuuagacuaacgagcaaauuguuuuuaguauauguuguacucucugcguguguguguguguguguguuuauuguguuacacuuaaaguaacuauuuuuuauguaucuucuuucugacaccagugaaaaucucugugguuugaaauuauuuauaaauuaauucuuaguacauagaaacacugaagaaaaaauguaaaucagucauuucaaucauaagucuuaauuuauaaauuauaccacgggcaaguuaaauagguucuugaacuucaguuuccuuaucuugaaaugaugauaauaguucuuuuggagcacagccacauucauucacuacaaaacacucuggaaccaagcauuucacauaagggaugcuuaacuuacgcuaguauucuguccucucauguaaaagaacaauuaucuaguauauugcauagcugauuauaacauuauuuagaggaugcuuacccuuacuuccuauuuuccagaaaucaucuucagagacaaagaaaaguaggaaauugagacauaaguuucagugaguaagacaaacaaaaaacuuagcuauugaugcauucaaguauuugcuguaauuccccacauggcacugcuuacagcauaagcaggguuugcacuucuauuuuuaacuuaauuucuaauucaugaaauuauuguucacauaaaacaguaaucacuauugacagcuuaauauuaaguauacuauauuuuguuauggaaacauacuuccauauuuuauuguauugcuuaauuuggagauuaugggugaauuuaaauacauggaagagagguuguuuguaaaccuauucucaaagcuuuaacuauagaaccuccagugaaugaagcucuuuacauuaguuaucucacaaaucuucuaaucggauuagaaagcugaauagguuuugcuacaucuaaauacaagucaucagauuuacccaugaaauaauaacuuaucaaagcaagucuuuuauugcuucuggcagagagcaagaaauaguuauccuauagaagguaaagaguuuucuaauaguuuagcacuaguucuggaauacaagaguauuucaaagcuaaaccugcuauaacaaugcaagaauaauagccaauuugagucagacacaaugcuaagcacuuuacguauccguaacuucucaucuuuacaauaauccuccaaaauagaugcuauuaucauuaguugcuucucacaaagcuuaaaauauuuauuugacccuuuauagaaaaaguuuacucaucccgccucuaaacuguccgaaucauagguauauucuugccuugauuucuucucaugcugguuucuacuuuaauaauucaaaucuaccuugccuucuuuuucuauucuaucauugaaauuuauuccuuuccuguuuaauuugaaaagagaucacaauucagguaaaacauuuauuucugauaggaagaauagaaguagcaaaaucuugccacuacuaaauuuugauuuugagauuuguuuuagaauggaagaguuucuaauagaaaaguuugaaauacaguaucaauuaugauauucugggucaucuuagaguucaugugucaccuaaaguaucccauggguauuauaaacacagcacuaaacaaggugaaugaauuuccuuucaccuauaagaaaggcuuuugucuuuaucccagugccuccaagaaauagaugagucaaaaaauauuauguguuuggguuuggguuuuauaccaauuugagagaauuaggcacuguucacacuuaauuaauucuauuuuucaucccaccuuugugacagguaucgugcuagagcuaaguaaaggcaaaaauucuugccuucaagauucugaaggugggaagauuaaaaaaaaaaagaggaaaaaaagaaagauucuaaagguagauagugaugaauaaauaugcaagagcaggggugagaucuugggccuagguagaggaaucagucuuaaucagagagaaagggaaguaugccuucauauaacaauacauuuguagcuaagaaagcaggauauuaguggaaauaugagucugaggguuuuuauugcauuucuuuuuacauugaagugaaaguugccucuggaaguugggguaagggcauuucaggaagugguagugauuaauguaucauaaaaucuaagcuuaauagagaaggaaguaaaaccuagagugauuuuacaaggagcaaaagaaagguaguuaaggaaccaaaaguuuaccagcaauaauaaggaauugagugauuuggaagaacagguguaguggucaaagagguggaaaaguccuggguaugacuaugguugugaaucauuuagcugaugugcauagggacauugggauugaggacaucaaggaauuauaaaguuguaguguugggguggugggcuuaucaucccacauugacaucauucaggauauuagcaggucuuagguggagagaaaaucuguagcuaaaauauuagaguccucaguaagucuauaccugggugaucaguuugaguagccucuagaauggauagaaagggauauuaccugauauccugaaucuucaaagaugugagauuuauacuaaagaguagaaaguguaagugacgagaauuugacaagaaugagaagcaugguauaaguuaacuuaccuugggcuucugaauaaauucugguguaaaguugcuuuagaaauaaucuaacacuaauuggaaucucugggccaagcuggugauugaaauuacugcccuggaacaagggagagggaauuauaugaauuaaaaaauagacuuuguuggaaacugcugggcuguccuugccuuuccaaucauaccacaaaaguaugucaguaggaauuugaaucacauuccacauuuguuuugaacaaaaacaaauacacuacuucauugaguacguguuaagcaauuuaaaaaagcaauuauaagggaaaaaaaaucuugaauggaguaaugaaaacaaagaaaaggcuaaaucaaagaauuucauucccauugguaagauuugguuucaugacauccuuaauuuggguaugagauuuuaaaagguuaagcaagccccaaauaagggcuuaauaaaaaugauaauuagaaguuuuuguauuauguuauuuuugcagaaauauucgaauugaccauauuuggguauuccaggaguuucugggguucuuuaaagcucauuuuggguacuuguaaucucucuguuuugaguaaaggauagucauuuucuuuuaaauuugugauuuuauuuuguauugcacaacuauggaaugauauaaauaguugaaugaauuaauuuuuaagccuuauguauuuuuuagaugccuaauaauaacaaaaaacugacaguuguuuaaucuuugcuuuugauauuacagguugaguaucucuuauccaaaaugcuugagaccagaaguguuucagguuuugauuuuuuuuugacuucggaauauuugcagaauucauaucaguugagccucccuaacccaaaauucaaacuaugccaaaauccaaaccuuuuggagugcugacacaaugcucaaaggaaaugcucauuagaauuuuuugcauuuuggauuuuuuggauuagggauguucacccuauauaucugauagaauauauaaguguuggguuuaccuuaaaauuuccauuauuuuuacauuuugauauagaaaauauauuguaagaacuuaguauauaauccauauuauguauaauguuuaauacagugaugaaauugcauuucuaccauagcaccuuuuagagcacugcccaaaaccauauaucuaugguauuuuaauugguagauucucuucaggaacccuucugguaagaaaacaagacgaaucagcuucagggaagaaaggauaugugauugacauuguaaagaaaucuuacauggacauuauaaagaaucggccaacgcauuaggauuucuaauuucuugcauugaccauucuuaacuauuuuagacuuauuguagugaacauaacucauacagaaauuaugagcaagugauaguuuuccauaauuacaguaaaauauaguagguuuuuguuuuuuacuuuucucuaguuauguuuauaucagauaaugaaaguuuuaacccuucauugugggaggaacagaggaaacagcgggcucaaguugcauuugaaugugaugaagacaaagaugaaagggaggcaccucccagggugagucuguucuuuauucuuuaaaauuugaaacaagucugcugauauuuaaguugguauuauauauacuaugaugucuggggauauaacaaaguauugaauuuauuccuuguccucaaggcacuugaaguguuauugauuccaaauauuucagacaugaaagaauuugggaacaauauaaaacuaugugauuuaaagcuaaauuucauaguauauauaaauauaagaggaaaacguuauuauaggcuagagaaauuaaccagcacuuuauuucaaauuaguacccuuuauguuuaacuucaguuuagcugacucuccccccaccauauucguaaugauuauuuucuccccuuucccuuucuuuaaugauuuauuuuuauaaaucuuagagauaaagaacucuuuguuaugaacauuuuguuucuuuauggaauugaaaacaugucacagugauaggaguaguaaauacauauuuuuuaguuacuuaaugaauguaauuauuugccccuuauacaaacuuagcugaaucucagaaaaugacaggcugaccuuggaaaaauauggcucuugguaugugagacauaaauauacgaauaucugaauuuuauauauacguagaugaauagcugaaaaauguguaucuguuucaaagcuaagugacacaauuuuuggcaauauucauacuauauaucucuaaauggaaauauuugagucugauaaaacuuuuaaaacauugaaauuuacugcaaagucuuauuuugucauaaaaccauauuuuuaucaagccuaaaaugccuucaaagccuaucaucugucuucacaguuaucccuaugagcuugauaucuaauguaauucagauggguuacagauuaaauuuuguuugagauugacauuagaaauauuuguacuucauauuuuacuuauuuuauuucucuaggagggaaauuuaaaaagauauccaacaccauacccagaugagcuuaagaauauggucaaaacuguucaaaccauuguacauagauuaaaagaugaagagaccaaugaagacucaggaagagauuugaaaccacaugaagaucaacaagauauaaauaaagaugugggugugaagguuagaaaauucaaaaggauuaaccaaagccuauuucaaguucuuauuuuuaaaugacaguugauauagugccccuuuucauguacucugaaugugcagucaugcaccacagaaugauauuucggucgacaugcucacauacauaugauggugguccuauaagaguauaaggggcugggcgugguggcucacaccucuaaucccagcacuuugggaggccaaggcaagcagaucacuugaggucaggaguuugagaccagccuggcuaacauggugaaaccccaucucaacuaaaaguacaaaaauuagcugggcgugguggugggcaccaguaaucccagcuacuugggaggcugaggcaggagaaucgcuugaacccaggaggcggggguugcagugagccgagaucguaccacugugcuccagccugggugacagagugacacucugucucaaaaacaaaaaauaagaguauaagggagauggcuggccaugguggcucacuccuguuaucccagcacuuugggaggccgaggugggauggucacuuacaccgaggauuugagaacagccugaugaagauggugagacuguuuauacagaaaguuuaaaaaaaaaaauuagcugggcuuggugaugugugccuguugaccuagcuauuugggaggcuuaagcaggagagucacuggaggccaggaguucaagaccagcaugggcaacauagcaagacaaccugucucuacaaaaaauuuuaaaaauuaucugggcaugguggcaugcuccuguaguccuagcuacuugggagacuugaggugagaggaucccuugagccuaggaguucaaggcugcagugagcuaugaucaugccacagcacuccggcaugggugacagagcgagacccugucucaaaaaaagaaaaaauguguaauggagcugaaaaacuccuauugccuaaugaugucauaacacaacuuuccuauagucagauauguuugcauacacaaauacuuucuauuguguuagaauugccuauaguguucaguacaguaacauguuauacagguuuguagccuuggggccauaggcuauauuacauauagccuauauguaauauaguauauguauauguauauguauguauauacauauaguguauguauauguaauauuacauauagccuauguguguaguaagcuauacugucuagguuuguguaaguacacucugugauguucacagaggaaaaaaaucaccuaauaaauuucucugaacauaccacuguuguuaagugccacgugacugcacuugcaaauuuaagguuuuguucucagcuaccugaacugggaaacaaauaaucagugaaguccauaauuacuaucauuaccacucuggcuauagaauguccaauugacaguguauugucagcauagccuuuaaaaaaaucauugucugaacaaagaagauaaugaaugccagaaaaauuauuauuauggaaauuuuucccccuguuaauauugguccauuuuaccuaauucucauuuuaaauguaauugcaaugacagacaguuggcauuuccuugcgauguuucagaaacuuucacaaaucccuaaaucgucuguauauuccuuuaggacuuugccacacacacauuauuguaucacagaaacaaaaguuuuaccaugucauuagaguuacuguacaguccacaaugagcagaaaacaauuuuaaccauccggaguugaguuugcugagcuaagugacucaguuguccacacuuacaagccuuggcagcuucuaagaggaaaguaaccuuggcuaacuuuuaaauuuuaauguggcucauggaucuuugggggccacgugcuccuaaaaugagcauuuuaucugugagugucacagguuucuauguuuaaaguuuucauguuugagauuaguccagaauuggaaguuggcaaauugcuuacaaauuuuuaucugaacuuuuaaaauagauauaaaacuuaaagaauaugagcucuuuaucuuuucuuuuacuuagaccucagaaaguacuacuacaguaaaaagcaaaguugaugaaagagaaaaauauaugauaggaaacucuguacagaagaucagugaaccugaagcugagauuaguccugggaguuuaccagugacugcaaauaugaaagccucugagaacuugaagcauauuguuaaccaugaugauguuuuugagguaugauuuuaugauuauucuggagcaacuauaagaacuuucaauuuaauauuuuauuguugcuaaauaaagaccugauacugauuguagaaaauauguuaaugcauucaucauugagaaauuucauaucugcaaaaauaucacucacuugucacuuuaaacuuacaaauuauuaugcccuuuguauucagauguuuaugcgaauuagauuauagauagucuaggcuacuguaaaauacauaauugcuuuuauuucuguaacuuaaaaaugaaaagacuacuauaggcauacccaauuauuuaacuuauuuaugcauuuauccuugaaagugaaagauuuuuugguugaaugucugagacaguuuuuagauguggaguuucuucuaguggauaaauaaaagcuggaacuuuuuuuaaaaaacagcuuuauugagauauaacucacauaucauacaaaucacuuauuuaaaguauucaauucaguggccuuuaguauauuuaccaaauugugcagccauuacuacagugacuuuuagaacauguuucucaccccagaaagaaauuccauacucuuuaccuguuacuccucacucuuuauccccuuuggcccuaggcaaccaaaaaucuacuuuauaugccucuguaaauuugccuauucuugacauuucauuuaaguggaaucauacaauauguggucuuuugugccuggucuguuucaccuagcauaauguguucaaguuuuuguauguuauagcauauaucaacacagcauccauuuuuaugaccgaauaauacuacauuguguauauccacccuuuguucauccauucuucaauuaauggacauuuuaauuauuuccacuuuuuggcuguaaugaauaagucugcagugaauuuuuguguacagguuuuuguguggauauauauuuucaugaaugaaaaaugauugcaccauuuuauauucccuucauacacugcuagugguaauguaaaauggugaagcuguaacuuuuuaauaugaauaucugaaguguuucugauuuauagcugcauuguucacugcaguacauacuagcuacaaguggcuauuuaaguuaauacaucuucaucccuaaaauuucaaaaugcauucaagcacaccaucucuuuuccugguuauccugugagcugucauuuacaacaggaauaauuuuuuaaaaaaaggaugguuaauaucacucaauacgcuaugguaugcacugaagcuaaugucacaggcugugaaaaaauuauuagguuuguuacagugaacuuaugacucauuuaguguaauuucuauguguaaggcacuguguuuagagcuaagguggcagaauggauaaguggauauagggauuuaaaugaaugcaaauauauauaauuaaggauagacugugcuaaguguguuagaaauguacuaaguguuaaagaaauuuaggaggaagauuuauggcugccuugagaagggggcauuucaccuguguuuuggaaaauuuuaauucgcagauacaggagaauggaaugaaauggggaaggaaugaugagagugaaagaauggcauuuggaacauauggaaaauaacauuuuauguuacugaauaacauaaaauguuauguuauuaacauuuuauguuacugaauaagucagagacaauauuaugaaauaagaucaguagaguagacagggcccugauuacgaggcucugaaaagccaagcuaagaaguuugaacuuaauguucuguaguguugaggagccacuaaaggcuuuuaauagaguguuacucuaauucauagagcuauauaugguugaaaguuacuauaguuguaagaauauuauaggagaugcagcacgugaacaucucaguauaaaaaagggaauagaggagcaguauccuaauguuugauuaggauaauggugccaugaaaaggauagagguacaaauuguacaaacagucuuggaaggacugguuguuauuuuauugccguaucuugaaaagguuuaauauguguuuauaauauuuguuuucccuuuaaagucuuaugacuuaauauuuauuuauuuaaagaaacaaaaauuuaauuuuuaucccccucacccccuuuucacuaggaaucugaagaacuuucuucugaugaagagaugaaaauggcggagaugcgaccaccauuaauugaaaccucuauuaaccagccaaaagucguagcacuuaguaauaacaaaaaagguuagauguuaaaggaaagugcuaagaauagaaauugccucaauaaauuuauaaauuuuuuugaaauaaauuucauugaauauuauguuauuugauacauuuuagaaacaaauuuuuagacauggcuuucugaaagguucucuuuccuucucucucauuuuuagggaaaguccuugauagucuuuucuuucuccucaugcaaauuuacuuauaaaggcauggacuuuaccgacagauaaacuuggauuguucauuucugccacuuaucugcuguguaauccuugaguuaauuuuauccauguguacauaucugauuugacauacaaugaggcuaaugaaggauuuuugcaucaaauaggcuagauaauguaucuuuuagcacaguaccuuauguauaguaggugcucguuauuuuauugauuguaucacaaaacauuuuuuuacacuccguccaaccucugccagccauucuuucauauaagacaaucuuagacucuuagagaucuugaaggauauguauccuuucccucaccccuccccucuagcaccugaguaucuuuacaucaucuuccucaaauguuuagccguuugucuuuauggcaucaaugauacuuauuaucaagguggcccuuggauagcuuggguucauuuuguaguagugauaccuagaauuuguugagcacuaauugcuuagguacuauacuaaauauuuuacguguuauuaucuaauugucacaauaacccccaugaugagguggaaguggaguguaucuaagaaagaacuuaacaaccaucuauuuuaaugguuaaguuaagagcucaaaaccuaaauacacugagaucaaaguuagaguccauuugcuacuguuaacuguaaauacaauccggacuacuugagcugugcuccuaagaucucagaacaucaaagauauccuuaauucauauaaucaucuauggauaugucuauauacacuauuucugugauuuggcuagaauucaguuaguuaaaaaaaaauuuguagcacuacuuuaaaaaaauacuacuuguuauacuaccuauuauagaauaugaacacuugucuguuucuguucauguaauugcuacacacacaaccaccuuacauacugagaguuuaccauucauaaacaaguuuaugaaauguuuuaaaaacauuaagaaagagcugaccuuugaaaauuccuugauuuguuuggugauuauauguuuguggauugaauugcuuauuuuuauuagaguagaugggaaaaaauuccauauauguaugaaauaauuucuugcccaguugaguucagaaagguuguaaaugaauuuucauuaucaguuuuucaaauuguaaaugggugaaaaguauauucauugaaauuaacugaccuuagaaaacaguacauaauaauaucaccuugucaguaacuaaaucgaauucuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguuuuagccgggauggccucgaucuccugaccucgugauccgcccgccucggccucccaaagugcugggauuacaggcgugagccaccgcgcccggccuaaaucgaauucuuaauaaccccagcauugguuacuuuuugaaaaauuauaucaccaucuaaaaauuauuuaaucuuuguauuaggacugaauuuucaggggugcuuccaauuaucaauauaauuuauuaccucauauauagaaccaggaugguauaauugccauuugucaucacugaaaagaauuucacacaauucuuggggaauuuaucauuaaucuuaaauuuguuuuguuucagaugauacaaaggaaacagauucuuuaucagaugaaguuacacacaauagcaaucagaauaacagcaauuguucuucuccaucucggaugucugauucaguuucucuuaauacugauaguagucaagacaccucacucugcucuccagugaaacaaacucauauugauauuaauuccaaaaucaggugugugaaccucuuuuacaguuuuuuauuuauacaauaaauagaaguaguaaggcagauaacaaauacauaaauauauaggguuuaauaaauauuauagaagugguuccaguaauauguuuuauuuccccauuuuuauugcugauuuuccauuuaguuuuuauacauuuccaucuuaaauuagauuuuuaaauggggaagaauagacuagauucucaaucucugguuaaaaaguugaauauuuauauauuuuuagauauggcaacauaaacagcauauuugagguaauuuaaguugaaaggaguauuuuuauaguuagaaaugcagaaucauuuugaggggcugccauuaaaggguucauucagauacucuugacuggugguguauauuuggcuuaggcuuaauuuuguaggacacacucacugagagagagauaaauguuaauuuguauagccuggaauuuagcugaagucuaaaacacauuuuauuauuuaggcucuugagaaauugguugucuauaauguuggcaguggguuugaaaagaaaaaaaaagaagaaauuugguuaucagaguaaggcccugccauucuaccauaguguuacucuaucagcuaaacucuguuagaaagauggggauuggcugggcugagcaugguggcuuaaacguguaaucccagcacuucaggaggcugcggcagguggauggcuugagcccaggaguucgagaccagccuuggcaacauggugaaaccccaucucuaccaaaaaaaguacaaaaguuggccaugugugguggcaugugccuguagucccagcuaccugggaggcugaggugggaggauugcuugagcccaggaggcggaaguugcagugagcugugaucaccccacugcauuccagccugggugacagagcuaggccuugucucaaaaaaaaaaaaaagagacagauugggguuggcuggaugugguggaaugccuguaauccgagcacuuugggaggcuaagaugauagauugcuugaguacaggaguucaagaccagcuugggcaacauggugaaaccaugucucuacaaaaaaauuggccagguauguuggcacaugccuguagucccagcuacucgagaggccaaggugggagguuaacuugagcuugcgagguuuaggccucagugagucaugaucaggcuacugcacuccagcauggguaacagaauugagacccggucucaaaaaaaaaaaaaaaaagaucgggguuacuacuaaaccaaaaguuuaauguguggauauuuuuaauagucauuuagaguuguucuuaaauuucaggcauauuuaaguaaaauuuguauauauuaaugcguguuguuggaaaagggaggugaauuuuaugccugaaaaugaguuuagguacuguguaauuauaaucacaaucaaucauuuauuucuauucuuugaauuugaagcuaugagcugcuguuuaaaauacuaauuuuuauaaccuccuagauauuaucguauuaauuuguugaauaauaaaauuuuauuuauuguugggaaagcgguaugauauuuucuaaauccugcuuuuaauauaaugaaauaaagccuaagcaaggaauacagcaacaccuuuuugugcuguauuucuaguaaugaaaguuaucuuuuuuguaaugggaagaccaguauuagggaauuuuuguggaaacauaacuugaauauguauacaagaggacacaaauacuuaauaucacagguagaaauaaaauauuuuguauaauuuuggaaugacacauuuaaaaguauuuaccaaauacagcuagcuacuuagaagagugauuagacuucauuuaucuuucuaugccuuuuacauauuugauguuaaacuuuggacaauuauucaguucuuugcuuuguacaauuuucuuaccuauauauuugaauguaauaacaacuguguacuucguuaacuaugguuaauuugguuaauaauguaaggcuucaaaauuaacuguaaaaauguccuuugcucuuuacuccacuauucauguuacuagguuucucuccauauaucugcccucccucaagcauuuuguuuuuuuagcacauucaugaaaagaugcagcaaacauuaaaauuuuauucauaguucagcccuuuaaauuauuuugugacaaaucagauugaguguauugaugaaaauuaaucuugguauuaucuaugaauuuuaauuguauuacuugucuccaacugaauauaaagcucuuuuaacuauuaagauaauauuuuaaaauuacaugcuugauaauaaaugccuuuugucuuugacuuuuauuaacuuuuuuaacuugucuaccuacacaauuuauuuauuaauguucccuguuacuaagaaaacucggcuuuauuauguuuuucauaaaauuaucuuuauuuuaggcaagaagaugaaaauuuuaacagccuuuuacaaaauggagauauuuuaaacaguucaacagaggaaaaguucaaagcucaugauaaaaaagauuuuaacuuaccugaauaugauuugaauguugaagagcgauuaguucuaauugagaaaaguguugacucaacagccacagcugaugacacucacaaauuagaucauaucaauaugaaucuuaauaaacuuauaacuaaugauacauuucaaccagagaucauggaaagaucaaaaacacaggauauugugcuuggaacaagcuuuuuaagcauuaauucuaaagaggaaacugagcacuuggaaaauggaaacaaguauccuaauuuggaauccguaaauaagguaaauggacauucugaggaaacuucccagucuccuaauaggacugaaccacaugacagugauuguucuguugacuuagguauuuccaaaagcacugaagaucucuccccucagaaaagugguccaguuggaucuguugugaaaucucauagcauaacuaauauggagauuggagggcuaaaaaucuaugauauucuuagugauaauggaccucagcagccaaguacaaccguuaaaaucacaucugcuguugauggaaaaaauauagucaggagcaagucugccacacuguuguaugaucaaccauugcagguauuuacugguucuuccucaucuucugauuuaauaucaggaacaaaggcaauuuucaaguuugauucaaaucauaaucccgaagagccaaauauaauaagaggccccacaaguggcccacaaucugcaccucaaauauaugguccuccacaguauaauauccaauacaguagcagugcugcagucaaagacacuuuguggcacuccaaacaaaauccccaaauagaccaugccaguuuuccuccucagcuccuuccuagaucagagagcacagaaaaucaaaguuaugcuaaacauucugccaauaugaauuucucuaaucauaacaauguucgagcuaauacugcauaccauuuacaucagagacuuggcccagcaagacauggggaaaugugggccaucucaccaaacgaccgacuuauuccugcaguaacucgaaguacaauccagcgacaaaguaguguguccuccacagccucuguaaaucuuggugauccaggcucuacaaggcgggcucagauuccugaaggagauuauuuaucauacagagaguuccacucagcgggaagaacuccuccaaugaugccaggaucacagagaccccuuucugcacgaacauacagcauagaugguccaaaugcaucaagaccucagagugcucgacccucuauuaaugaaauaccagagagaacuaugucaguuagugauuucaauuauucacggacuaguccuucaaaaagaccaaaugcaaggguugguucugagcauucuuuauuagauccuccaggaaaaaguaaaguuccucgugacuggagagaacaaguacuucgacauauugaagccaaaaaguuagaaaagguaauugaacaugaguuuuucauuauuuucuuuaugaacuuaauuauuuuccuuaaaaaugaugaaacaagauucucugaauuacugauuaucucuuuauauucuagguguuuuucucugguacugggaauagaguuccaaauuuaaacucagccaggacaauugggaugauaauguguguuucuauccucuccuucacuccccacuguuucuaacaaaaauguauuaauuuuauauguuuaugugucugucucuuugagauugugcacacauacuaaaaauacacguaccucuguucagcauuuucugaacuuugcuauuaauaauuguugauuaucuaaauuuaaaaaauaguuuacuauauaguuaagacaauaacaaaaaauguauugcaaauguaaauauuucaucuaauauuuuuuccccaguccacaguauaugaacuaacauugucacugacacagauggcuucuggcauggcauuuauucuuaacuuuucugaauuucuacauuucugaccuacuuaaacucaguuaaguguuucuguggcucuaguguugcuuagcaauaguugauuaaauaacuaaugcucguguucaauuuauaauuuuauguguagauguucaucuuuugaaaggaguuaaaaauguagauacagauauauauccuuguaaaaccaauaugaaugccauagucauauggcccaaguguacaagacaugauuuuucuuuaagauuuaacuuuauacuuacucacuagauuuuacccaagcauuaucuuucuuucuuuauuaaauauaaaauguguucuuaaaaacaggugaacauacaacuucaauuagccauuuuuaaaaauuccuuaaauaaaauuuucagaaaugccuaaaauauauuaguaccucauaucaguuuacaugaaaucucagccuauaauuguucuuuuuagugcaguccucaacuuuaaaugaacuuuaaauagguaaauauccacaagcauuaggcuacuucauucucaucuaugcauuuuauuucaucuaguaacucuguacacacuguugaggcuauuugaacuuuugugcuuuuucuaaggcacuuggaaauuucuuaagcagaagaguaacauagguguguuuuauaaauaaauuucuggugacguuguggaacuagauuuuagaggaagaggcuguagucaaagagauugaguuaugaugccguuuaguaaucuagauaagaaaugaaaugugaacuuuuaucagugcaguuaagacaaaugaguucaagagagagcucugaaauagacuuuuaacaagaguuuacuucugauugaauauuccuguaaucaaucagaaaggaaaagggauaaagcuugagauugugccuuaaauaacugguuguugggaaugucuuuggcuauuaguggacauagaggaggaguaggagauuuggaagaagagaugaguuugguuuuuauguucuguguaguuuucaucuuauauggcuguuuuccuacuccugucugacagauauaccuggauuucaguacauaagaagcaaguaguaacuaucucauuguucagugugccaauccgcuuuuuuuuuuaauugccugaaauauuuacauauuuugaaauucacgguacggguucuugaagaguauaugacaguaguuuccuaguuguuuucacuaguaauuuagaggugugaauuaguugauugaaacuaaagagaagccuuaugagaaaagaaacagggcaaacugugucugaacacaaaucugcaccugauaacucccauuuucaaggauaucauacuuugaaguuacgaggggugcuuguucucucaucauuugcuugcccagacuccugccuuccagaccacuaguugacuacacuguaguaucuucuagcucaucaguugggaagcauuucuagcaaauaccaaaguauauauccugccguuaccauaacucuacugcauuccuuuuaggauauuuuauucuccaugucuuucuuaaauguaugcuguguuugccuguuucaguucuuaaaaaguauucacaugugagacugcuuuuaccuaacauacgugaaacuuuuaucuuaaauggauucauguuuuauaaaccacauuuuuaaaagaauuuaaauuuuuaaagaauuacuuucaaaaaaauuuuuuaaaaagcauuuagagagaauuuuagucuuaacaguuccgaauccuagcugugcugcucaguuagcuacuuggacaaauaacuuugacuuuccuuaccuugguggauucauguguauguuaggugcaaugaaaggaacuacuaggauuguuuaaaaauuagauggguuaauacaugcaaagcacuuagaaggguaccugacacauauaacuaacugcuaaauaaguguuuauugcuauuaucuucauccucaucaucaccaucuuuuaaauacaaagaaauuaucagcugauuaaaguuauuuuuuuaaaacagcagaauauugugcaauagguuauuuuaugaugguaaaauaauuauuuuucuuaaaaauuuauaguucauaauuuuaaaauauaaacagauuucauacaucaaagauuaaggcuuuuuuuauuauuauacuuuaaguuuuaggauacaugugcacaacgugcagguuuguuucauauguauacaugugccauguuggugugcugcacccauuaacucgucauuuagcauuagguauaucuccuaaugcuaucccuccccccucccccgaccccacaacaguccccagugugugauguuccccuuccuguguccaucuguucucauuguucaauuuccaccugugagugagaacaugcgguguuugguuuuucguccuugugauaguuugcugagaaugaugguuuccagcuucauccaugucccuacaaaggacaugaacuuaucauuuuuuauggcugcauaguauucacauuuucuuaauccagucuaucauuguuggacauuugcguugguuccaagucuuugcuauugugaagagugccacaauaaacauacgugugcaugugucuuaauagcagcaugauuuauaauccuuuagguauauacccaguaaugggauugcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucuaucucauugugguuuugauuuguauuucucugauggccagugaugaugagcacuuuuucauguguuuuuuggcugcauaagugucuucuuuugagaagugucuguucauaugcuuugccuacuuuuugaugggguuguuuuuuucuuguaaauuuguuugaguucauuguagauucuggauauuagcccuuugucagaugaguagguugcaaaaauuuucucccguucuguagguugccuguucacucugauggugguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuaggucuaacguuuaagucuuuaaugcaucuugaauuaauuuuaguauaagguguaaggaagggauccaguuucagcuuucuccauauggcuagccaguuuucccagcaccauuuauuaaauagggaauccuuuccccauuucuuguuuuugucagguuugucaaagaucagauaguuguagauaugcggcauuauuucugagggcucuguucuguuccauuggucuauaucccuguuuugguaccaguaccgugccguuuugguuacuguagccuuguaguguaguuugaagucagguagcgugaugccuccagcuuuguuuuuuuuggcuuaggauugucuuggcaaugcaggcucuuuuuugguuccauaugaacuuuaaaguaguuuuuuccaauucugugaagagagucauugguagcuugauggggauggcauugaaucuauaaauuaccuugggcaguauggccauuuucaugauauugauucuuccuacccaugaguaugagauguucuuccauuuguuuguauccucuuuuauuucauugagcagugguuuguaguucuccuugaagagguccuucacaucccuuguaaguuggauuccuagguguuuuauucucuuugaagcaauugugaaugggaguucacucaugauuuggcucucuguuugucuguuauugguguauaaggaugcuugugauuuuuacacauugauuuuauauccugagacuuugcugaaguugcuuaucagcuuaaggagauuuugggcugagaugauaggguuuucuagauauacaaucaugucaugugcaaacagggacaauuugacuuccucuuuuccuaauugaauacccuuuauuuccuucuccugccugauuacccuggccagaauuuccaacacuauguugaauaggaguggugagagagggcaucccugucuugugccaguuuucaaagggaaugcuuccaguuuuuguccauucaguaugauauuggcuguggguuugucauagacagcucuuacuauuuugagauacgucccaucaguaccuaauuuauugagaguuuuuaccaugaaggguuguugaauuuugucaaaggcuuuuucugcaccuauugagauaaugaugugguuuuugucuuugguucuguuuauaugcuggauuacguuuauugauuuucauauguugaaccagccuugcaucccagggaugaagcccacuugaucaugguggauaagcuuuuugauguguugcuggauucaguuugccaguauuuuauugaggauuuuugcaucaauguucaucaaggauauuggucuaaaauucucuuuuuugguugugucucugccuggcuuucguaucaggaugaugcuggccucauaaaaugaguuagggaggauucccucuuuuucuguugacuggaauaguuucagaaggaaugguaccagcuccuccuuguaacucugguagaauucagcugugaauccaugugguccuggacuuuuuuugguugguaagcuauuaauuauugccucaauuucagagccuguuauuggucuauucagagauucaacuucuuccugguuuagucuugggagaguguuaugugucaaggaauuuauccauuucuucuagauuuucuaguuuauuugcguagagguguuuuuaguuuucucugaugguaguuuguauuucugugggauugguggugauaugcccuuugucauuuuuuauugcgucuguuugauucuucucucuuuucuucuuuauuagucuugcuagcagucuaucaauucuguugauccuuucaaaaaaccagcuccuggauucauuaauuuuuugaaggguuuuuugugucucuaucuccuucaguucugcucugaucuuaguuauuucuugucuucugcuaguuuuugaauguguuugcucuugcuucucuagugcuuuuaauugugauguuagggugucaauuuuagaucuuuccugcuuucucuugugggcauuuagugcuauaaauuuccuucuacacacugcuuugaaugugucccagagauucugguauguugugucuuuauucucauugguuucaaagaacaucuuuuuuuucuaccuucauuucguuagguacccaguagucauucaggagcagguugugcaguuucgauguaguugagcgguuuugagugaguuucuuaauccugaguucuaguuugauugcacuguggucugagagacaguuuguuauaauuucuguucuuuuauauuugcugaggagugcuugcuuuacuuccaacuguguggucaauuuuggaauaggugugguguggugcugaaaagaauguauauucuguugauuugggguggagaguucuguagaugucuguuaggucugcuuggugcagagcugaguugaguuccuggauauccuuguuaacuuucugucuuguugaucugucuaauguugacagugggguguuaaagucucccauuauuauugugugggagccuaagucucuuuguaggucccuaaggacuugcuuuaugaaucugggugcuccuguauugggugcauauauauuuaggauaguuaguucuuguugaauugaucccuuuaccauuauguaauggccuucuuugacucuuuugaucuuuguugguuuaaagucuguuuuaucggagacuaggauugcaaccccugccuuuuuuuuguuuuccauuugcuugguagaucuuccuccauccguuuguuuugagccuauguguguccuugcaugugagauggguuuccugaauacagcacacugaugggucuugccucuuuauccaauuugccagucugugccuuuuaauuggagcauuuagcccauuuacauuuaagguuaguaguguuaugugugaauuugauccugucauuaugauguuagcugguuauuuugcucauuaguugaugcaguuucuuccuagccuugauggucuuuacaauuuggcauguuuuugcaguggcugguaccgguuguuccuuuccauguuuagugcuuccuucaggagcucuuuuagggcaggccugguggugacaaaaucucucagcauuugcuugucuguaagguauuuuauuucuccuucacuuaugaagcuuaguuuggcuggauaugaaauucuggguugaaaauucuuuucuuuaagaauguuggauauuggcccccacucucuucuggcuuguagaguuucugccaagagaucagcuguuagucugaugggcuucccuuuuuggguaacccaaccuuucucucuggcugcccuuaacauuuuuuccuucauuucaacuuuggugaaucugacaauuaugugucuuggaguugcucuucucgaggaguaucuuuguggcguucucuguauuuccugaauuugaauguuggcuugccuugcuagauuugguuaguucuccuggauaauauccugcaguguuuuccaacuugguuccauucuccccgucacuuucagguacaccagugagacguagauuuggucuuuucacauagucccauauuucuuggaggcuuuguucguuucuuuuuauucuuuuuucucuaaacuucucuucacgcuucauuucauucauuucgucuuccaucgcugauacccuuucuuccaguugaucgcaucaguuacugaggcuugugcauucgucacauaguucucgugcugugguuuucagcuccaucggguccuuuaaggacuucucugcauugguuauucuaguuauccauuagucuaauuuuuuuucaaaguuuuuaacuucuuugccauugguuugaacuuccuccuuuagcucggaguaguuugaucuucugaagccuuccucucucaacucaucaaagucauucuccguccagcuuuguuccguugcuggugaggagcugcguuccucuggaggaggagagguguucugauuuguaguuucugguuuuucugcucuguuuuuuccccaucuuugugguuuuaucuaccuuuggucuuugaugauggugauguacagauggguuuuugguguggauguccuuucuguuuguuaguuuuccuucuaauagucacaacccucagcugcaggucuguuggaguugacuggagguccacuccagacccuguuugccuggguaucagcagcacuggcugcagaacagcggauauuggugaaccgcaaaugcugcugccugaucauuccucuggaaguuuugucucagaggaguaccuggccgugugaggugucagucugccccuacuggggggugccucccaguuaggcuacuugagggucagggacccacuugaggaggcagucugccuguucucagaucucaagcugcgugcugggagaaccacuacucucuucaaaacugucagacagggacauuuaagucugcagagguuauugcugucuuuuguuugucugugcccugcccccagagguggagccuaccgaggcacgcaggccuccuugagcuguggugggcuucacccaguucgagcuucccagcugcuuugguuaccuacucaagccugggcaauggcgggugccccucccccagccucgcuguggccuugcaguuugaucucagacugcugugcuagcaaugagcgaggcuccaugggcguaggacccuccgagccaguugcgggauauaaucuccuggugugcgguuuguuaagcccguuggaaaagcgcaguauuagggcaggagugacccgauuuuccaggugccaucugucaccccuuccuuugacuaggaaagggaauuccuugaccccuuguguuuuccaggugaggcgaugccucacccugcuucggcucaggcauggugugcugcacccacuguucugcacccacuguccggcacuccccagugagaugaacccgguaccucaguuggaagugcagaaaacacccgucuucugcgucgcucacgcugggagcuguagacuggaccuguuccuauucggccaucuuggcuccucccaauuucucgauuaagacauuuuuaaaaagugaagauagucucuguauguuuagcuuguaaaaauuuguuuuaaauaccuauuuaucaaggaugaugaucuugaauaauuuucuguuaaauauacuuaucugucagaaacaauaccaauaaaaugucaauagagacauucguauuuauauacacacuuauauacguacacacauaaaacuaacaaaaauagaaauuucaauggaaauuugguauuuucuucaugauuucauuauuaaucaucucuucuucagaaaauauaguucagaagauuauuucauaguuuagguaauaacugguucaaaagaugaaauguuaauguacugcuaguaauuaucugucggugagauuuggggacuuuuugauacauuucuaaaauguuuucauuuugaaagauaaaaugguaaugauaaaugcaauaguaaucacagaagaugggauuauucaacaaacagugcuuuuugaaaaacuuacaauuuugauaaauaggauuaagauuaauagauuaagguaaaaguuauauaucaagaaggaauucugaaagcagagacaaggaguucaaccugguugaauuaaagauguauuuugagaacauuugauaauaaaguaugaauauuagaaagucauaauauauaaaguuuauuugguauuuacaaagugccagaaacuacuaucacuguacaguuaccuugcuauacaaauauuucucaauuuucacaugaguccugugugauauuuuuauuaucucauuuuaccauaaggaaauuuaggcacagaagaguuaaguaauuuucccaggaugauauguguuacguaguguagaggaaugacuuuaaaagccuaucagaagaauuucaaguugacacaauaaacaaaagagagccacuauuauuuccugagcauauagaguauuuuaggauaucuuaggcaaaaguguucaggaugaauugauaagaaguagcuuaggaaacaguuucaauaauaaaacagccaaaugagagauacuugagcugggguuuuggcucucguggugaugagucugaaaaacacuuggguuaaaauuguuuaguuuuagggauggaaugagaaaaaagauugaagagguagccaagguuucugauuugagauauuuggucauuaaccuuauuuaauuaauuaauuuuuuaaauagagacagggucucacuauguugcccaggcuggucucaaacuccuggccucaagcaauccucuugcuucagccucucaaagugcugugauuacagaugugagccaccaugcccugccaaaucaauauuuuuuuaaaguucugguaguuaaggaaaugaagucuuuaaagcauugugguauaguauaaaaguuuggcaaaaaauagcuuaguugguuuugaauauauugaauuugaugugaugacugugugcaaguaacauggaacacaauacgauacuagguuuagugaugcaaauuugagauacaaaccaugugaaugagugaauuuuccuaggcaguaauuaugugggauaagaaaaaaguguguuuuuaagagacugaaaagauacauuguuuuaaguaauguuaaauugcuaagauugcuagacauacuuauuauuucaaagagcagcccauuccaauucagugauauguacacccuuaagauuucuucaccaucuuucaucuuuuccccucuuacccaccauuaacugcuagaaauuuauuauuuuaaggcaggaugguuugaauaaccaaacauuuguaccuagauuuuaccuuuguucuuccuuuaaccuagguaagugguuuucaaacuuuacuauauggggucuauaaauaaaacuguacauuccgagugauuucagagauuuucagauuaauuuugaccuguguguguguguguguguguguguguguguguguguguguguguguguguguguguguguguguguguuuugcuuuguaugugaaccagcauccauuuauuuguuaucccauuuuccaguaaggaaauucaggcgcagaauaauuaaguaauuuucccaggaugauauauauguuaugugaaggagggggaacaacuuuaaaagcuggucugaagaauuucaaguugacacaauaaauaaggugaagccacuguuacuuccugagcagauauaguacuuuagguuauauaauguuagaugugguucuuuugaguugucugagaguuuaaugugauucuaccaccagccuccuaaaaauaauuuuauucaguaaaaauaauccuuaauauugaagcauaauuugaguaauuugccagugaaaauuaacucuuuauuucugcaagucucucguggggaugcuuucuuuuccuauguucaaaacauucuaaaaucauguaauucugaaaauugucccuguuuuauuuauauaacaacuuugugcuacuuugaugcuuauucauuagaugguguaaucagaauguaugggcguuagaagcagauugaaagugcuacauaaauauauuacuaauuaacuacuuuaauagcagcaggauuuagacuccaaacuucauugauucaaagugguagaagaugauggaggaucucuauucacuccccuacacccaccaucuuaauucuaauggcaaaguagacauuuaaaaauuuuacccugggggcuuucacagugccugcccuaccucaugaggucaguucccaaauuaaaauuugcuacuuuacucagcugagaguuaguaguaauaaucuauugaagcuuaaguaguuuuuaaaccuuuuaauagucaccccucuuaaccucccacugccaaaaauaaaaaaaaaaaaacaaaaaaaacuguaccuggaauucaaagauacaaaguagaugucaccuugaaaauuucaagauuuauuuaauuaauaagcaaaauuugaaaaggaauaagaacuuuuuauuucagaggugaaugguuacuaucagcauuuacuaacauuccuuaugagaacucagauauuaagcauuccaaaccauaauaugauuaacacaacaugguaaguguuacguucacucguuauuauacaacuaucaguauguaaugaacaacauugcccaggacauuaugccuagcauuuaauugagcacucuacaauguguugugacaggaagcaguuuuacguggaugucugcacaaaccugaauuuaaaaccagaccuguuuugagcuucagcuuuauucaucaguaaaauauuuacaguaagcucauguguuuggagaugacagagaaagcuuugcuacaagaucugucuaaaggguuaaucaggccacuugagucaauaacacauuaaagcucucugcacagcaaaugugugugucuguuauuuauguauguaugaaugauuucuuuguuuuuuuuuauuccagucaaauguuuaugaaaccuccagauugccucguuaaauccuuaaccuuggugaaaugguuugggaaaaugcaggucugggcuauaaguuuagcuuuuucuuuagucacuacuuuagauuucacagaauaacuggaaguguacaugguaauuuuauagaucuuuuucuuuauggaauccuguauuucuuggcauuagacgucaacuucagauuuugagaaggaauguauuugcuaagaguaauacagaaaugcuuguuaugauauuucuguauuaauaacaagccaugcucaaaaugugguuucauccaguuugaccauuaagcccucagcacucagggacaugacuaaaggcacucacauggaagaacggcaguucauaacacugggaauaaacaaguggaacagcgggaaucaggcaguguguuuauugagguacaucuucaggcaguacugggauuagcaauuagguauucauaugaauucaguuugugagaggauuccaucaauggcucuucaaauuuaagcagcaaaggccaccacuaacuccuaaaauauagugaucuuuaauaccaguuuauuugaauggggaaaauuugccacacauuuucucguuuucuucuucuuguaauuuuagagcagcaggagcauuuuaaaaguuauacucaccaagccugggcaagguggugagacccugucuacaugaaaaauaaaaaaacuagccaggcaugguggugcacaccuguggucccagcuacucaggagccugaggcaggaggauggcuugagcccaggaauuugaggccagccuggguaacauagcaagacccaugucucuuuaaaaaauaaaauuaaaaaggguauaucauaaauucgcguauguuaaaacuauucucuaaugcaagauauuuuucuaaacauuuagaaauugaaaugugguccggcacaguggcucauaccuguaaucccagcaguuuagggggcugaggcaaaaggauugcuugaaggaaggaguuugagaccacccuggacaaguguagugagaccucgucucuacaaaaauaauaauaauaauaauaauaacaacaacuagccaggugugguaaugaggaccuguaguccugucuacucaggaggcaagaucuuugagcccaggaguuugaagcugcagugagccaggagcuugcuauuguacuccggacugggagucuaccucuuaaaaaaaaaaaaaauuuuugaagugguauuuuuugcaaauauauuuuguguuauguauauuuaaacacucaguuuguuuaauauguuagaauuugcauaaaaugaaguagauucucuaaaaauucauuugacuuagaauuacuggguguugguaaaauuuaucuuuauauagagaaauuaauuucuguucuguauaugacuuuagauacacauacaucagcauauggcgucaacuccuauuuucugacauauauaucuaagauguguuaggaguaaaggaaauagcauucuaaaagcaguuauaugucuguacuuucuuccuuugcuuaaacaugugaaugguuguauuuacguguaauuuguguauauguauauguugucauauaaauacaugguaaaugguuccaauuucuuucacuaaugaaaauuaguguugcaugauacuucucugguuuugggguuacuuguaaauaagucuacguauauaacaugucucguggauuuugcaugcuacacuaaucucuguuaaaucuauccccucuuuauucagagcaugcugucaagguccuuuaauuccaauuuuacuacuguaagcaguuuucacuguggcagcucuagggaucugcauggcagccagggcagucuugccuugaguguugcagacagaagagguucuggugggcacauuuuucgagugaguaccuacacuagaccaauacuuuuagcuuguagaagagaaaaccccaaauuuuaaguguuuuaauguuuccaggaaaaaaaauguuuacucuggguuagaaaccuugauuuccucugaguucuuccauggcuuaguucuaaaucuuucuucagagcugauaaauucauuaucuccugaguuucuuuggucauaaacuaaugauguagucagcccuuguuuaugcaaaaaagugaacaauaggaauaacugagagaucuucaaaaacuauucuuuguaguauguuuucucuuaauauuaaacuuuucuauuccuaaggauuuuaaggcuaugcuauauguaauccauagaccuguuacagggaggaauaauuuuaacuccagugacugagaauugacugagagaaagcacuacccugaacuaauguuaaucauaauucacugagcaugauuaacugugagacuggagaaauuguaauaagugucagugaaaagacaaagcacaaauccuuucuuacucacauuuuacuaaacauuuccuuaguagugaagaagaaagguuuaugauuuuaaccaaaauucagugugggggauaaaaaggcagagaaagaaagaacaacucuggcauggcccuguuuuaagauuuuuuucccauaacaacuugaaguaguagcauggucucuagaauauuuccuuccgccccucuccuucaaucccgaaaagacuguuuugucucuaauaacccuguuuuauccccuccccauaguuuccuugugaaguauuugcuuacuucuggguccuuuacuucuaccugagcgaugguaucccccauuuuaauauaucccuggcuuucuucugguguuacagaauaggagcaaucuccuggauucucuuggcucuggcuguaccugaccuagacguaugcuguccucugucaccugccaccaugugauuccuaugcuguuaagaguggcagcaguuacguugaaaccucccaauuuuauuuauuuauuuauucauuuauuuauuuauuuauuuugaggcgggguuuuguucuuguugcccaggcuggagugcaauggcgcgaucucagcucacugcaaccuccgccucccgaguucaagcgauucuccugccucauccucccaaguagcugggauuacaggugcgcaccaccacacccggcuaauuuuugcauuuuuaguagagacgggguuucacuauguuggccagaggucuugaacuccugaccucagaugaucugcccgccucagccucacaaaguguugggauuacaggcaugagccaccgcgcccagcuaggaaccucccaauuuaaaagaugagagagaagggugauaacuaucagucucucauuccaagagucccuggggguaaagaucaguggcuuuuauuaacucagggguaaucuuugccauuuauagucaccuggagcaauuguauuuuccacauucuuuuauaguaacauuuugugcuuguuuuuuuuuaauuuggagccuuugaauacauugaauuuuacuucuacauucauggugugcuuguucuuuuaaaaaguagauaaacauaguuauacauucacacuugaguuaaaauuucaagcugagagcuaaauucauuuauguauucuaaaagcacaucucaaaaagggagaaggaaaauaaaguauucauugcauaaauacacaaaauuagaucacgucuaaaaauucuaagccaugguuugaacuaacugcacaugauagauguguugcggauauaauuucuaagauuaaauucgaaauccuuaacucuauauguaugcuguaguaugucauaacaaaguagauuuuagauuaauuuuucaauaugaugauguaguuugcauuucuauguugcuagccguaaacuguuuugaauguaacaauagugcuauuuaucacaaucuguuuuguuuucuaaaauauauauagggauguguuuagaacuaaaauugaagugaaaaacauaugugucuugcuuccuggcauauuuauaauaauaaaauauucaggggcccugugcagugguucacaccuguaaucccagcacuuugggaggccgaggcaggaggaucacuugagcccaggaauuugacaccagccagggcaauguagggagacccugccucuucccccuccccgccuacaaaaauuagaaaauuagccaggcauggugacaccacaacuguuaucccagcuacucagaagacugaggugggaggauugcuugaguccaggaagucgaggcugcggugagccuugaucacaccacugcacuacagccuagguggcaaagugagacucucuccaaaaagaaagaaagaaagaaagaaauauucagggguaaugagauugagucuuauuuuuccccuaaagcuaucagcuugguaaacuauaauacagggauauuauuuggccuauaaagauauuaaccaguuaauugguuuuaauagcauuucuccauaucaguacuucugaaacuauugaacucauaucaauguggcagaauuaagcuaaagcaaauuuuauauucauuucacaccccaaucuuaucccaauaaaauaaguuuuguaagacuauaaguguauugguucugcuugucauuaaaauuuaggggaaaaaaaucccaugggguacuguucuauugaaagaacagcaguuaauuuuuuuuuuuuuuuuuuuaccaaaaaucuuuuuauagugcucaacaugaguguguuuuaguuggucuuaaaauuugagacucuaaacuuugauuaauaacuauauuuguuguucaaagguauuaaaagcuagguauuacuguaaguaaaacuaaaaggaaaaaauaacaugcaaaauucaucuucuacauguguguauuguacauaaguagauuaacaauauguuuucauauaagcuuuucauacauacaaaaauaucuugcuauguaccuuuggaagaagugaaagauacuaauugauggcaguaaugauggcaguguuugauuugggucuucaucuuugcacuauuuggcaauauuuuuuccuaaucuucucucaagugucauccucuugguuucacaucuuaaagaacauuauuuguuuacuuuuuauuuccugcucauuagaagcauccccagacauccaguucaggagauccuugucaagaugguauauucauuucaggacagcagaacuacucaucagccacacuuagucacaaagauguuccuccagacagcuugaugaaagugggugcucgggaaaacaaaauguaguaucugugagcuuucuauauuuugcagcuuuuggacuagauauuauaugugcuuuagaugaaaauacuuuuuugagggcuuuccccccuuuauuaguaaggauuuuuaaaauaucagaaauacaaaauagaauuugacccugucuacuauuucucaguucauuucaugauuuuucuacccuggagaauuauuuuauuuuugcauuuagauuucuguuauauaguaccaccuauuuauuuuuucauuugaaucaaggccuuuuugguauuccugauaguaaaacuauuuggagaauugaaaaugaacuuguguuaaacucuucauucuaggaucuuuuacuauuacuaaagucaaauguaauuacuucaaaugauaauuagaaaucaucuugaaagacuuuuguauaugguagaauagaugaugguuguguuuuuaguacuuuuguugcaauuaucuauguauggccagugccagacagauaauuuuuuacuauccucccucaacuauuuuuucuuauuuucuuaacugauuccaugccucuaguaugaccagauauaauuaugaagcauaguuauuuauuacauaaaacuucuauguugcucuucagaguagcuaccuggucaucuaauauauaaguucauaagucaucuaauacuuaaguucaucuaauauauaaguucuuaaguuucuauuauuuuacccucuuuuaauugagcuuugucauccaguuuuuucucauuacauauauuuuguggcuuaggguuacugaguuuaauacuuucuaauuuccugagccaucugcuaauuguagcuuaauauauuccauguguauguuuaacacugauguaggcaagaccaaauauuuggugucagggagucuuaaggucaguaguaauugucaccuggauuuuacccaggagaaagauacugaauuugcauguaggaauaaaugguauaaacguagagaaaaucaugggcuaucugcagaauuguauguaaguaauaaagcaacagcagaaccaguuaauuacucaugggcaaaucaguugcauuaaaucuacagugaucaaguaauaaacagguuuuuuuccuccagaaauguagggcuaauauagcccuucauuuuccuucucuccaaccaauauaagauuugucaguaacauccuuguguccuaucacagaauacccauguguguuccuagacuucagaauuuaacuaaguucucaaguauaacacaguuuaacagugaaauagaaugccuuuuuuaaaaauacaaaucuauaccaaagcuaaacuacuuuauaucuuucagcaagguucaccaagaaaagcaugcaguucugaaaguguugccauaucuuucugcaaacuuuucuauuuggguuaauuuagggaacuggaccucaacuauuucccucauaguuuucccauaauuuccuugucuaugagauuuucugucuguuaauaaccaacaaggaaauuauaaguuaauagcugaaccauauuuuucuacacaaaaaucuuuuuauaugcaaauauuuguaauaugacuguaaccucuuuuuuguuguuguuuagagauggagucucgcucugucacccaggcuagggugcaguggcaugcucauagcucacugcagccucaaacuacugggcucaaaugauccuccuacuugagccucccaaggagcugggacuacaggugugcaccaccaugcccagcuaauuuuuuuuuuuuuuuuuuuuuuuuuuuagagauggggucuugcuguuuugcccaggcugaucuugaacuccuggccugaagcaauccuccuguauaggccucccaaaaugcugggauuauaggcaugagcuacugcacccugccucuuguuuuuaagauagauuccucaugcuaacagaauaagcuauuagccacauuucuacaaaggugauuuuaagucagguuuauucucuaaaaaugagaggcauuaaaacaaagauaguucucuaacaacaacaaacuaauaauuuaaauuuuuuugcuguuuacuuuaugaauaggguagaaugucaacauuuaauuuuuauggcuaauagucuauggaauuaauaauaagagauuauaaacguugcuaacauacacacaaggaauaaaucaguuuucuacauagauagcugaauugacuuguuaauuuuggaaaagaaggaauaaaagcagaaaaauaaauuuggaaagaauuuuaccacaaaauuaguuuuuuucugaagaaaaacgucagcaaauguaccuuuuguguauguguguuugauuuaguaugggaaaagauaugcaucucauagacuggcuuaaauuuuaaaauuuugguauacuaugugccauuuuaacauuugguuauuauaagauagauacaucuaagaaaauacaaguguagcucacaaaaaagcaaguaauuuaaaauguagauaugauguacuuccauuugaaagcuuaaaaaagugaguguaacaacaagcacucaggaaacuuuagaauuaagacauuaauagcuuauuucuuuuaaguuuuaaaauuauagaaaaauaguaaguggcaugguauuguuugacuuaauuagaaugugaaaacucuagugcuuuuguaaugcuccaagaagaaauccaaauauuugaaauaagacauuauuauuggucauuuuaagauacuucauguuuuucuuagaugccuuugaguaauggacagaugggccagccucucaggccucaggcaaauuauagucaaauacaucaccccccucaggcaucuguggcaaggcaucccucuagagaacaacuaauugauuacuugaugcugaaaguggcccaccagccuccauauacacagccccauuguucuccuagacaaggccaugaacuggcaaaacaagagguaagaauaaucaagacuauuugaaauaugggacuaagcuuuuuauguauuuuuauagguuacuuaauuauuaguaaauccauacagaauauuaacguaguuauuaccauuuaaaguuuuauuuuuauguuacguuuauaaggcguuaaacuugguaauuuuuauuugacuuugugaucauguaacauaggauuuaguauuuugggcaugauuuauuuauucugauacaguuucuuuaccaaaacugguugauacuacaguagucagacauuccuuaagaauauaaauaggagaccauuaagcugaaauuguucugugacacuuaaaaucuuaauuccuuagauuuugaaauuugacuacagacuucaaacuacuuugaguauuuaaucuuaaaaaguacuuuaaaagucagcgagcuacacauucuuauaucuugauaguuauuaauaaaaugauaauauuagaaagguagagaucaaaugcuuuauucauuuugguugugucucuggugaaagggaguguuuuauaacacaguuuuaauucuugcaucuuuuuuuuuagcuugguuauaaaaacucucaauuggucauguuuuaaaaucccaacuccuuugaagccuuuaaacagauuugauaaauaaagaguuaguaucauaaaaccaccaguggaucuuuuagauaucuuauguaacaagccacuaaacagagauacuguguaauuuagaugucccacaaguggaaacugauaauaauauacauguuuuguguuuauguacuaugucauauaaaaucugugacgucuaaaaaguaaaacagggucaauauuaauugauuccuuauccucauaagacaagcaauaaaauuaggagcuaugcuuuauauaaucccagcucugccuuuaacucacuaacucauuaacauaauauucuauguuguauuucacuucaucugaccaaauauuuauuuuugaugaauucuuauguuuauguuugcuuggacuuaaccaaucaguauuuaaauauggauguuguugcauuauaacuuuuucugaaauaguaaguuuccuuuauuuucauauuaacucagauucgagugaggguugaaaaggauccagaacuuggauuuagcauaucagguggugucggggguagaggaaacccauucagaccugaugaugauguaaguuuucuuuguauauucuugaaacaccuauaaaguuuuauuuaccgauugaauacuuaaauguaagugaaaaucuaauagauguuuauguaaaucuagguagacaucaccuggauuccccacucuauugcuuaccuuuuuguuuuguaauuugaucaguucaaguuaaaacaauuuaaccaaaaacuaugaauguuuaugauauaaugaaaugauuuuuaacuuucuuauugcuuuuucacacaccuauaaaaguaauuuuauuacucucaagagaaaucacuaaagucagaauuacuagagguaaaaauaacuaguuuguuacaguauuacucagagaagucagggagaaaacuuguaccaugauucaaauauuugcaugguguggaggaaaaauugcuccuugguacucuguuauuuauacauacuguuuuuaguuaaauaauuuuuuuuguuguuaaaggguauauuuguaacaaggguacaaccugaaggaccagcaucaaaauuacugcagccaggugauaaaauuauucagguaauuaaaauaaaucuuuuuuuuuuucauuuuauaacacucuaauguuuucacaguuuaaaauguuuucacuuuaacuuugaaaauugugggugggaggcugaggcaggagaauggcgugaacccgggaggcggcacuugcagcgagccgagaucgcgccacuguacuccagccugggcgacagagcgagacucugucucaaaaaaaaaaaaaaaaaaaguuugauacaucauaggauuuuguuuaagcucaggaauguuaauuuuuacuaauuugagggggauuagaguaccacuucuuggaugugggcuauuguccuuucagaaauggagaagaaaaauuuuaaaucugcgaaacucauuuuuuccuguccccuccuuuucuuuguucauucagcuacucauuuuaccuaaacacuuacagucuuagaaggaagacaaaccuaggacacaaguauagcucucauuuucuaccccuacugucaccguucuuagcugagaacuaaagaacuuaaaaaauaauccucaaaccaaaaaaaaagggagagagagacauuaaugucuaauagcugaaaguacagauucugaaagccagacugccugaguuuaaauucuggucccaacacuuucuaaaaauaaaacuaauuaaaaaaaauuuuuuuugaauaauuuuaagcuuagaaaaaagccacaaaaauacuacaacaaacaccaguauuacaucaauuggucaccagucguucauaauuugcuacauugucuuuaucauuuauucuccucuuucuucucuuuuucucccucccucccucuacacacacacacacacacacacacacacacacacauacacacacacacacagucacacucacucauacaguuauacacauuuauuuuucugaaccauuuggguuucaauuugugacugagcaaguuacuuugccucuccaugccugggcuuucucuucucuaaaauaagauagugaaagaaucuuuuuugagcauuaugagaaucaaaggaucuaauucauauuacacccuuagaauuguguguuugguacacaguagaaccucaguaaauauuaagcuuaauuguaagaaauaugguggucuugaugugauggcuccaagacaaugggaagaguagcccuugcccccugcuacgcuacaguuuggucaccucagauacacauuagcauuauacgacaccaugucugacauuauuucuuaaguaagugauuucuaacauugggcugcuacauaagaauuggcugagaaguuggacaaaauacacauuuuuagaccccaucuucagagacuuuauuccuugguuuggguagggccugugaaucuguauguuauuuuaaguugccaaagugauucuuauuuucuuccaaguuugugaacuacuuggcagaaaugcaaauaaauaacuauaaaauguuuuuccuaaaagcauuuuuccucuucuaggcuaauggcuacaguuuuauaaauauugaacauggacaagcaguguccuugcuaaaaacuuuccagaauacaguugaacucaucauuguacgagaaguuuccucauaagcacuguggacaaaaaaagcggggaagacagcaagauuuauuggaagauacuuacaggggaaauuaauauuuugacuauuuuuauauauaaagaagaacucaaaaaauuauguucaaauuuguacauuaaugaaauaauggaacuugugguuagagggaaagaaccacuguacagaauauaaaggagacuguugaauucauaccauauaaaacuuguuagguuuuuaaacauagcaaucaaggcuacaaaaacaaaccuguguuguuuuuguauagauuguagguuuauuuuuggauuucauauacaugacugaacugugugcaaggcaauaguuagccuugauuuuagcccagagacagauggcagagcuaucucucucauagcuuuuaugcccuuauuuuuauucaacugguauuaauguuuuucuccugaaacuacuuuuuuugaugugggcaagagauuugaaguguuggcuuuugcuaugugcauauugaauugaagagugaguaggugaagguggugcugguggguucacuuuccaaggccagacuaaaacaguuauuuucuauaaaaaucuggaagcaaagaauggggauggggagagcuacgugguaguauguuuuuauuaggagaauaaugcaauaaaauauguaaugucuuuuuuauaaagcaaaaaagacaauaauugcauuuaugagcucggcaggaucuguucuugucauagccauugacuauacauuugcuacuggugauucaguuuuuaauuuuuuagucacaggaaauuuuuaacucuacuguagaugcauguccaugcauuuucuguguuauggaaauccacugauuuuuuuuuuuuuuucaaauggugguacuugcaaucuguuuuauaauuagugcuccauuuaaaucuaauuuauaauuuuuauuuuaagcagcaaaugaaacaaaaauggccaguuuuaagauuguguugccuguaacacaaaauguuacgaagguuuaggaaagccucuuugauuuuuguuuggccuugcauugccuugguaaaguaaaaggaaacaguacacuuggagcuaggaaaccaaagcaagcuuugugaaacuggcacagugauagagaauugcuguggagaguuauagagcaaagggauggguccuugaggccugccaguguguaaagguguucaaauaaagggcuguuucuacagguaacauuaaaugugaacucaacacuuccagagucuuuaaaggguuucuauguguaucaguguaauaguguuuuaccaccaacugccuuucuuuguuccuaguuacuguaacaaauauuugaugauagagguuuauuaauuuuguuuauccagaccauuaauuuuauuuguuuuuguucuauguaaucaaauaaaauuugaguaacauguaaugguaaggauuaaugcaugguuauuuggaccagaaaaaagugccauagaagaccaauaacuguuuaguugaggcuagucuggaaccuuucauuagagcaauauuugguuauugcacuucauuuuuauuuacuaagaaaugcaauuugggaauuuuuaaucuguuaugcuuuguuuaucaaccuugauuuuaauuaagacuuuuauaagacuagcuuaaaacaccaaccaacauuauuuuugcaaaagugaguuggacucacuuuccauucuugcuagucagaguaaguaggcagcacuuuuaaaaauaugugaacucaaauauugcacuucuuucaagauguuaucaauugguuauuguacuguauaguuuuaauaauuuugauugaaacccuuuaacaacucuuuguaaauuuuaacucauuuuaguugauuuucaguacuauuuacauaggaauugauuuuuauggauauaguagaagaaaugugcuguauuuugauaaaauucacuuauuguauguguguuguaaucuaaaaaaaaaaagaaugacaaacagcuucuuuaagacaagucucgguguucccuuuauucuuaguuuguuuuuaaauauuaauuuuggcauucuaaaauagcuaacauuucuuuuauugauuucagauuuucacaggcacauucuacuuuuaaucagaaauauauuuaauaaguauaauugugaaguuuucaacuacuuuaccuugaaccacauauaccaauuauaauuuuggaaaaggaauuaagccucacggaacaauggaucuucagcaaaccuuaacuucauugucugcacauuacauugaaguauuauaaaugcaacagauguuauaugcacuggcauuuuauccuacucuaguuaguuaaaauuuuauaguauucuugcaacacauaaaguugcguaagaaacuuuaccaagaggaguauuauagccaaguuuucuuugaaaguauuggaaaacuaaaauuaaaugacaaggacuuugaauuagaauuuugcuguaauaaaguuucaaaauuugaauaaaauaauuaaauuuuuugagg

SEQ ID NO: 192456 - RNA, 41397 nt, Homo sapiens
uauaaaauauuauuucaucauuuaaucuuaaucauuuugaaacaaagacagacuucaauuuuacacugcuugcacuuuauuuuguacagacauuucauuaauuauuacucaauuuugaggugcaaaccuucugaauauagcuuucauuuuggaccaaacaauuuguuauggcaauaaauaaugaugcauugaaaaaccaauuuuuguauuugauuuaaugcacucuuacauuuaagaaauuauauauacauucuugaauuucaacuuaccaaaauagaauagcuuuuauuuaacagccuaagcuuuuguuuuccugacaaauacugaaacuuuuuguuacauuaaugcugcaaaguuguuuaucaccucaacuuucucacugcuuugcucauaacuaagugugauuacauggagagagaaaguuuuguaacaguaacacaugauuuagaguuuaaaaucauaucagaagaugggaauuauuuaaauauaccuuauaaaaauaaguggcuuaaucaaugagaaaaaaacccagggguuuuuggcuuauaauuagaaaauaaguauuauucuuaguuaauaguuaauuaaaaaaaaucaacaaccuaaaaaguaaaaccaauucugauguguucaguagcugaaagauauguauguuuguagguauaauauacaaauacagacacaaaccauuacaguaauuuugaaaacaacuagaaagcuuauacuguguugacaaauaucagguuauaagaggacuacccccuuuguuuuaagcaaacuuuuucugcugaccgaauagcuaggaaaaaacuggaguuaacugaaauauuucuaaccaaaauauuacaaaguucuaagaaacaacucuaucuucuagauugaggucagccaacuauacccugcaggccaaaucugcccagcugccucuuuuuuuuugagacagagucucacucugucgcucaggcuagagugcaguagcaugaucucggcuuaacugcaaccucugccuccccgguucaagugauucuccugccucagcuucccgaguccaacugcuucuuuuuguguacaccacuguacuuuuuuugccuacuggcugcucuugaaguacgauggcagaguucaguauuugugacagaaaccuuacggccugcaaagccuaaaauauuuaguaucuuguaccuuacauaaaaagugugcugacucguguucuagauaacuugcuagggacaaauggucucagauacacagcuuuuggagaacaaaguccaauggucaucuaaaaugaaaugaaauuaaauaauagguguagaaaauauacacauguucauuucaaauauaaauuacaagauaaaaucagaucucuucaaaacaaauauuuaauauuuuaaccauuuuacaggaaagaaaauuuaaguaacauauuuacuucguuguugacgucaucauuuuacaaagguaacaaaaagagcaguucugugaaacuaaaugaaaagccuaacauuggaaguuuccuucagcuuuccacuuuaauggcagaagauaccacacagacuugugcgaugucaucauauucauauguucucuuuaagaaugugucuguuagucuuaagccagagaugcucuauugagagagagagagaugagucuaaguuuucauucauucagaggaaauacagacaucacaaaugacuuguaaguuaacagcacccaaauauuggaauuuuugaaaagacagcauacuugcagucccuguacugaagaaagcagaguaagggcaagacagagcgaagaacuuggaugcagcuuucccagcugucuuccugaaauuccacaccaguggauggaauugguauugcacauuuccaaaaccagauccauaguccuuucacugcuggaggaaucagaauaauaggaauaaaucuuguucauuucacaaagagguacugcaauauuucuacuagugacaguaaacuuguuuucuccauauccaggagaauaaaaaccagaaagagaaaagcuauuauaacauuuuuuaugucacuuaagauagaaccaggaagaugaaaggaagucacaccuucuagcacuuaaaauagccucagacuaaucugccugucuggauguuggccuucugguucuauuacucaacacuggccuccuggugcugaucuggugcuaccauuuuucugggagacuuccacacauuugugucuaaucuuguugccauauauucucacuauuucuguuagguacucuacaggaaaagaagaaaacaacugauucuggucuaguccuuuugauaccuaaucuauguuacuuuaccauaacuugggaaacaacuggcaggauucauaagacauaaauacuauucagguuugcuaacuggauuauuuaccaagaaaagacuacuucugcuuauaauagauaucaccaguucagcuuaaauaaguuaaaaaaacuuuuaaugaaaguaugcacauuguucuucuuuaaauaaccaaaaggcucauaaugaaaaauagucuccuaccaccauucacggcuacuuauggcuuuuagcuguuuauucuuauacuuggcuccaaauuuuaaauugcuuauuuaaauuuuauuuuuuuuagacauauugacuuuauaauauuaacuuguauaugccugaaucucccuaacaagcauuugagauggcuacuaugugccagagaccaagguggaugcacuacaugaauauuguuaauuucacaaaaauccaguaagacuuauauauguugugugcaugugucugugcaugucccugguguguaggggcagggaaugacauuuauauagagaggaaacuaaagaucuaagagacaugugcuuuuuagaaaacuuguaugaaucaccaaaaguuaaagugaacaccaagagaaguuaacuuuugaaaaaaauaacacuugugagcuggucaauaaacugauuugcugaaaaaacuuaaaaaaaaaaccaaaaauuccccaacacccuguaacacccuauaagcacagggucuuugcccuguauuguuguuuacugagcucacgauguggcagacacugaguaaggccaugucccuucuccugaauaauuccaguccagugagaaagagacuaauacuuacaguaauauaugagugucacuaaauacacaauauaugagugucacuaaaaaacuaaguuaaaauuuucuaugauggagaaggcaugaauaccugugcuuuggaaagucuagguagcuucauagaggaaguggguauuucuguaauuuugaaggauaaauauuuccuaucuuucuaauaccaaaaagaauaaauauggaauuaaaaggauuauacauucacacuaagaggacuaggauucaucacugcaauauuauaaaaauaccccaaauaauaauacaaaccaagugguaauacaaguaggagcagagggcauaggacuggaacuuaauucuauuuuuuucugguuucaaagcccugugcucuuugcuuccugacaguucagauuaugcucucucuuuacugucaaaacccaguuuucgaaucaaugaucuccccuuacauuaaauccauaagcaauguuugguuucuuaauacucaagauacagcucaaguacaagcaugccucaaaaaaucuugcuacuucaauucauaauauauuaauacauaagaaccuauuaguucauguuuuggugaaggaaguauaaacaaugaauaccuaccucauagggugugacaaaugaaugaaauaaaauacagaagaugcauaauacaauaggcccuuaaaaauauguaauuauacugcuaccagaugaagaauuuuacaguacucaauaucaacaucagagaaggcuguaugucaagaggaaaacuuaaaaggagauaguaacaaaaagauuuuaaaauuaucuucuaggcaggugagguagaaaggacauccaucuacaaacaguggcauuaccugcaguuuguuauuuuacagguaauaugaaaagguucuucaagguuuacgguaucugguauugccuccaaagacaaccuaacaucuccauaaccuggagccuaagaaaacaagcaacacaguuaauguauaucuaucacaaaaccuuuccauuuuaaugaaggcaccacagcagcacauuuacucaacagcuguuggguuuccaagcugauguucuaagaaaauacuucugauucacuuuacuugucucucauuuuaaauucuuuugcagcuacugccuguggaauagccuggcagaccuggacuguuuuuguuauauaauuauuccauguucaguagaguuaagaugaaucucacagguaaguagucaguaaagaaauuucagggaguugaagggacacuuuccagaugcuguagcuucuauguguguaacucuaaauagguaaaguuauuuucuaaagaaagagggggaugauguugaaaggagccaggaagaaaaucaugacuuuuuacaagacgcacagaugaggauggauuauaacaacacgaaggcuuggaacaggccauggcagaaaaauaacuaacggcuauauuuaagugggcccaggaaucaucaucaucauuuuuuaaaaauuauugccucaaacaguggaaagaaaaguaaaauuuggaauaugucaaaacagguaauauucagcauaaagggaggagaauccugucguauauucuuacaagcauaagaaaaagaagccugguagcuaucccuacucucagagaagaaauuagguaaaauaugcaaccaaugcuuauaagauaacuuuaguagaacucaccuucugaggagaugccucagauuuuuaacaucuuaaaaaugguaggaacugaguaggugaaugaaguaaguccaagaguuucaggacauugcaaaauagaaaaccuuaauguguuuggaaaucagaagaagagugagcauguguuaccaaaggagagacacuuaauaacaguuauuuuaauuucugugugauaaagaacacguguauuaaggauaaauuaacauuugaccauuuuucauucauggcaacaccagucuucgaccuaccuaucagugacacuauuaaucuuuucugcuccaguaguaguaaugccuuuuauagugcuccaauuuuuuacugcuggauguagaaaaaauuaaguuguucuaacuaccugucuuucacacaccaaaaccccagcgaaguuuuuuccagacucaccauucuuugaaguuggcuggucuguaaccuuccccuuucaccuagauuuguuuuccauacuauauccaauuuuccaauuacuguuacucccuuaaugaugccugcuuuuucugcaaauucauucuuuggcuuuaggcaguauaaguacuggcguguauccauugguugcaaauaugcucuugacccaaacguagacacacugagagggguggagacagagacggagaaaauucucuagcaucuuuuaaaagaaaaaccauggcugugauuguuccuuuggauaggaacuggaugauguacccuccaaagaucaacaacagaacauguuaacgauuucaauacaaauaaaaagaacguauacugcaaugauuuauuuuuccuucauuuuuuucaguugauaucgaaaaucuugagguucuuuauaguaauuggaccccgaaaggcaggggucccuuuuuuuuuuuuuaaauaauuuuaagagacagggucuugcucugucacccaggcuggaguacagugguaugaucauagcucacuguaacuucuaacuucuggguucaaggagguucuuuauaauagaauguaauauauuacuuauaaaauugaacauguaucaauuaacugaaaagugcaacagaaaccagaaccuuaaguauccugucucuuuucucuaaaauuaucaaagauaagaguuuagaauaauaagagacauaccauucuaaacuaauuuucaaaaugaacuaaaacaucuagaaaagaauggaaaauuguuuuccucagugaggaugaaagaggcuaugaacuuuucuguguguaaccaaccuaagaauauaaaagcaaacuuuucauuccuaauuaagaaauucagaugcuaucccaagcuauuaccuucuucuucuucuucuucuuuuuuuuuuuuuuuuuuuuuuuguuuaaaauacaaggucucucucugucaccaggcuggaguacaguggugcaaucauggcucacugcagccuugaacuuguggacucaagcgauuuuccugccucucucccaaggagcuaggaaugcaggaguguaccaccaugcccagcuaaauaaaaaaaaugccaaguugcccagguuggucuagaacucauagcuucaagcaauccucuggccucagccuuccaaaggguuaggauuacaggcaugagccaccacacccagccuauuacuuucuuaucuguauuauugucaacuuuacauuuauucuuccucuuuuaaauuagcuguggaaagguguauguauuuccuuuucacaaaguauuaaaccaucuauuccuauguccuuuucuuuugauguugagagaguauuucuuuuuuuaaacccacauucacccuuacucuuuuuaacuucucuaccauuccuucacauuccuccauuuuauuauuugcaggauagcaaugauaggauucauauuuaccucacuggauuuuuaugagacuuaaaagaccaaaugcuuugaauaguaaaacaugaaauuaaaagggcuaggaucuuuauuuuuauguaauggagggaugaagauggagcacaggagaguuuuuggaaagugaaacuauuuugcauaauauaguaaugguggauacauguuauauauuugucaaaaccuacagugcuugacuauagucccagauacuugggagaucguuugaguccagaaauuugacuucagccugggcaacauuaaugagaccugucucuuaaaacaaaacaaaccaaaaaccaaaaacaauaaaacauacaacaaaaagugugaauucuaauguaaauuauagacauuaguuaguaaucagugucaauaucauuucaucaauuguaguaaauguaccacauuaaaacaagauguaggccaggcacaguggcucacgccuguaaggacagcacuuugggaggauaaggugggcagaucgcuugaggucaggagcugaagaccagccuggccaauauggugaaaccccaucucuacuaaaaauaaaaaaauuaaccaagcgugguggcaugcaccuguaaucccagcagcuugggaggcugaugcaccaaaauugcuugaaccugggagguggagguuacagugagccuagaucaagaucaugccacugcauagagcuggacucuuucaaaaaauaaauaaauaaauaaauaaauaaaaauaaaaauaaaauaaaaaacaagacguaaauaacaagagaaacugugaggaguggaagaggguauguggaaacucuacuuucugaugaauuuuucuaugaaccucaaauucuuuaaaaaaagucuauuaaaaaaaaacccacugaagagcaauggauguuuagaaaaacauguaucuuucaaaacaaggauaaagacuucauaaauuaauauuuaccauucuccagcuuggcugacugaauuuaauucuguuacauuguacauaauagauggcuccagugaaaccuucuccauaaacauaggugagguugucauauucugaaucugggcuuccagaaauacuucaucagucugaggauaugaaaaaaauauccaccaaggugugguggcauuuaaaauauuuaucucaacaaaaauaucuuaucuauaugaagaaaaaauauuaaccacaaaugugauuaguucaugccugcaaaucaaaguuaccacaauuaaugcaagaaaagaaaucuucacccuaucauaauuaacaggggcaaagucaaguguuagucaacugauaccuugucaaacaauggauggaggauaacuauauuuugucuuaacaucccaaaauacuuaacuggaauuucauuuacaaauacucuuucuuuucauuagguauuaaaauauuaaaaugugcuuuaguaugaugaauauaccuaugcuccuauaauuucaguauuacguuaagauaauuaagucuucauuauaauauggcaguauaacuuugauugucauauuaaugccaauuuagauaguguagugaccacuaauacuaugaauaaucuauuuuguaaucuugaaggauuuaacuuuuuaaauuaaagcaauuugcgaguggucauuagugauuucuuaguucauuuuaaauguauauugagggcuaaaaaaagaauauguggauuauacuucaccaucguagagcuuuuaaaucaggcaaaagguauuuuguagccucagugacagauuuuaaagcugaugcuauuuagcaauauuugccaguagguaauuuuaauaauuagauaaauuagauaauuagauaaauuuagauaaauuaauuccccuaauuaugcuaaacauuauuuuaugcuauuugguuauuauuuuccuucauguaauugaaggauaacagacuaacuugauuuaucuuugaaacaaaccuacaugaaaaaugauacacuaaggguauucaauaauuuuuuucaaaaguuucauaguaauauguuuacuacacauaaauaacauaaaaucaacuaugaccagaaaaauuugccacuuaagagcuuuuuauuuuuuugagacagucucauucugucacccaggcuggagugugguggggugaucuugguacacugcaaccuccgccucccggguucaagggauucuccugccucagccucccgaguagcugggauuauaggcgcgcaauaucauacugagcuaauuuuuguauuuuuaguagagacaggguuucaccauguuggccaggcuggucuagaacuccugaccucaagugauccacccaccucggccucccaaagugcugggauuagaggugugagccacugugccuggccuaugagcuucccccaacccccacaagauggagucuugcucuguugcccagaguagaaugcaguggcaagaucuccucucacugcaaccuccaccucccagguucaagcgauucuccugccucagccucccuaguagcugggacuacaggcagugccaccaugcccagcuaaauuuuuguauuuuuauuuauuuugagacgaaguuucacucugucacccaggcaggagugcaguggugcgaucucagcucacugcaaccucugccuccugaguucaagugauucuccugccucagccucucaaguaacugggauuacgggcaagugccaccaugccuggcuaauuuuuguauuuuuuauagagaugagguuucaccauguuggccaggcuggucucaaacuccugaccucgugauccgcucgccucggccucccaaagugcugagauuacaggcaugagccaccgcgccuggcugagcuuuuuaaacacuaacaccaagaaaaugaaaaucauuugcaaaaauauaaugauuaaguuauaauauaauguacuauuaucuaaaauaaaacagauucuuuaguuuuugggacauguguucaaaugaaaauagaaauaaaaugauuuaucaguuuaaaaaaaugcaucauuuaauggcauuuuuugguuacugguucuaaaaaaaaguacauauaucccaucaauccauugcuuuuaaaaaaauaaccacagacccacauuucaauuuaaaaacugcaauuuucugcauaaauuuaggaagagcuuagauaaaacgaaagaaaaacaagcagcauaauggaaaaucaaguuaguuugaacaguuaguguaaagcaauuugauauuuuaaaaauuaagaauucagugcuaaggcaguugauguuauuacauauguaaugugauauaagcaaaugcugcuuauuguaaauauaacuuugaaaacaaaauuuuagccaaguugggaaaauuugcuuuucuucuguuucauuuugucaagcggccaucaucaccugacccagacuuaaaacuaaaaccacugugcaucugaaaaugaauuucgauuauacagucuacucaaagaacugaaggcuaggauaaucggguauuuuacaguaagaugaugaaaaucacaaggccauuugacacaagguaacauaccucuuuaaaaaaaaaaucuaaagaagaaacacugaaaaugagaauuguuucaguaugacaauuuaacuuuugagcuaauuuugccccacggaauagaaaauugauauaauuaaaaaguacauaaaauuauauauaaucuuucugaagucacauaggugguauucacaacuaacuguuuuuccacuauguuuuguaaagagagauuaauuaggcagagucaaaaaguggugaguaagaaaaguauaaaaauuuauaauaaaaaaucaaauuaccacagaacugaggucacucuaauggaaaaauaaaaaagaauaauuagaaaaaucagaguuaaauguuaaagaaaaaagaauuacuuuaaaauaaaaugcauuucugcauuuuuuuaaauuacuaaacaagacagcauuaguaaauaagaaaguaaacaggaagcaacauaaagaaauaugacaaaccauuuuucuaaaaaggugaaacugcuaagguuaaaugacaauggaauagagaagaacccuauggcugaauacucaacaguagcaaacuguuaagggcacauuuuggagcagagagguauaccccaugacuuucuaguucuauaauucuuuaccaacauugcaauucuucauagauaauuuaggaugaauauauacuauccuccacauucagaauagauauacaccguauaccuucucuuaaauuuauguaauaauggaaucaucuuucuaaggaauaucuugggcaauuagaguuccguugaucacuucagggaauguggggcugaaccacuugaaaaaauugagaauucucuucuucuuaguagauuucauaguuagccuuuuuaaaacuuauauauuucuucaauguuuuauuaagagcaaucucaaaugucaccuccaucaaaugcauagcuggaaaucauuuuucaccucucuagguacccaggauguguuacuucacgauuuggguuauaugugugggaggggcuuacauuauaguugcaucaugucagucuccucuacuggaugcaggucccuucagaauugggaagauguucuguuuauauuuaucuucgguaccuggcaggugaccaaauguuugaaaccuagcuucuagucucaccaaucugccugcaaggcuuuucuaucuuagaagacuauaacaaaguuucucaugaacuuguuuuccuuuaggugauucacauauuacagcauuauuagaaacaguaucaaaauauauguuugagacagauguggggccaauaauauuaacuguaaaaggacuacagcacagagcaauaagcaucacuuacugauauuacugugguuuauuaacuccuacaaucuaccugaaauuccugguuggggucaacauaaucugccucaugcuaguggcugaacaguauuuguuugucuaauagguaauauuaaguaucuuagagagacccaaaaugcuauuuguucacuccugauuuuuaaagugagaucuauuuucaaaaguucagaauauuacugaaauuauuuugauugaaguuuguuagcaagauuuaaagauuaugucaacauauaauguuaacugacaaaggaagcaaacaaaauugucgugauuauaaaaauagaauauuauauauaagugaauaaagacugcaaaagaguauguauaaugaaaaaucaauuggugugguggaauugugaauuuuuauuucuuuauggagagcaugucacuucuauaauguuuauagaaaaacuagcaauuuuuaaaauuauucacaaaucacucugaauauuagcguuauaaaacuaauuuacagguaucuuaguguacuaccauauuuuuaaugaagaaaaccuaaaauaacugaauaugugacuccuaggagccaguuacagaaaauaacccaccuauugcccuauuuuaaauuaauuuucuaacagaauaguuaacauuuuccccucauacuauaaaugaaaucuuuuccagcaaaaauuagacuauuuaaaucucaccaugcugacuagcuauacuguaauuaaucaacagugugguauuaauaacaaaaaagagggaauaaaugcguauuacuccaacucaccuaucccccacaaaagaaacaucaacuuuguaaacaucuaguaaucuugaugaugcuuuucccucucgucaaauagguaugcucuuuccuauguacuugauacuucauguccauuuguaacccugcuugaaugccuucacugcuuugacacuuguuuccaaccugcauuccuuucagacuccaauccaguuuuccuucucuuccauaaagcuucuuuaaacuauuccaagaucacauucccgagagcucuugcagcacaucuuuucguaucauucucacuauauuccauucuagguaguuuuguuauuacaugcauuuuuucuuuucuccuaauaggucuuugcugcagguuagguuccuuaacuuugacaucuuagaaauccuaguuauaguauaaauuuuacugaguaaaaauucagauuguggaugguaaaaauaaauaccgaauuugccaugugauuaaaaaugucugaucauuaucugguuuuagaguagcagagauauaaucuucauuucaaaauacuguauuuggauaucuuugaauuuaucacugguaugaaacacaagauuuuggggcauaagagggcuagcaagagaucugauuuuucugcagcucuagaagccaagauaaaacagaaucuuagaaaagaaauccaagcaauaaauccuuucuccuauggcaaguucuuuuuuuuuuuugggcaaguucuauuuuaucucuuuuuuuuuaggguaaaagauagaguaucuucuauuauaaguuacuucucuuuuugccaaauuuguuuuucccaaggagcuuuuaaagccauuacaccaaacucagcaaccuaauucuggcuggcaaacugacuacccuggaaauaauuuaaugugcuaagcuucacuugucaguauuuuuccaugugaauauuaaaucuauuuugcagcguuagaucuacuaauucaauuuuuguaaaaucccgaaccacauguaaauauucaacagauugcuaguguaacaaccaccauuaaauggaaugagagggcaaucauuuaacgaaaggagaugaaagccuuauaaaauuaacgagaauaaaaaucaagacacauugauuccauguaagcugaaaaagauuaugagaccuauaauaaaauuauucaauuuuaacugaaauuugugauuuuuucaaauaauuuacagucacguuggcgauuugcuucaguauuagaaauguauauaagagauuuuuagucaaauacgaucuuaauguuuaauaugaaaucccauuaaacacucaacacuuaccucugcauuguaaaauuugguuuucacauccaaugguuugagaaccugguuaaauaaagcauaucaaucaggagauuguuaucaugugaccauuuauuuauuuauuuaaaucaaauaguguaaguuugucagucauuuuccaauuuuaauuguuaaaagacuuuucuaauagguaugcaauauucuuccaaaaaaaaaaaaaaaaagaaaagaaaaaagaaucccuaauguauuuuuugagaggcuaccauuauuucuugacugggugauaauuacauuacauggguuuuugcuccauaauauuuuguuaaaccaaacacauacauuuuauguauuuuucuauaucuauauucacaaaaacuguuugcaaaaaaaagcaacugagcugggugcaguggcucacuccuguaaucccagcacuuuuagaggccaaggcaggcggaucaccugaggucaggagucgagacaagccuggccaacauggcaaaaccccgucuguacuaaaaauacaaaaauuaacugggcgugguggcgggugccuguaaucccagcuacucgggaggcugaggcaggagaaucgcuugcacccacaaggcggaggcugcagugagcugagaucgcgucauugcacuccagccuaggcgacaagagugaaacgccaucucaaaaaaaaaaaaaaaaaaaaaaaaaaaaaaaaaaaaaacugaaucacguuuuauuuucuuucaaaaagcauacaaaugaaugauucagcaaaagaauggcagauuuuuuuucccuaugaauaguauuuuuucuuccacuuacaaaggaaugaaaaaaaccauauacaguaucauauuuagaucuauauuuauaauagacauacgugguauucacauuuccucaccaccccccccacauaaaugugcuaaaccaguguuuugaaacuauuuuugauggaagcugaaaacuguauauuaauacaaaacucaacuuaaaguuccagugauuccuggagucuuugaaggaagcucagucuacucuaagucaauugucucuccuuuaaauuucuuuagaaauuugauauuauuuacucucauuuuaucuggacuuuacacucauuuuaucccuugucuacauuguguguuuucucaggccauaaaaacaaguuauuuacuuuucggagacagagucuuguucuguugaccaagcuggagugcaguggcgugaucacagcucacugaagccuugaagccuggggucaagcgauccuuccgccucagccucccaacgagcuaggauuauaggcuugugcuguaguccuaggucauguugucugggcuaucuugaacuggccucaagugauccuccccacuuugcuucccaaagcacugggauuauaggugugagccacugugccagacucagcuauuuuuuucuuuuauuuugaauaaacaccuucaaguuucauuacaaaaacauguuggcaaugauaauucuucugcuuuuauucaccuuaauuuagucugaguuuagacugcuagucauaugacacauucaaaaauauugagcuauuugcuuuauuuggagcuuguuuucccugcagauaaacgggaauaacuguauacuaccaggaagaaaaaggcauauaaaaacuauuuaccauugucauauucaauaccugaaauuugaagaauuuucugaaauacauuuuuucuccagccugaguuguauaacucacagcacauaccaagcugaaacagaaagaugucuuaacgauucugagucauuuuuaauuuuaauaguaaaucaaacacaccucaauucuacuaagaaauuuggaaaacacuuauaucuaugguguggaugugugagauuagagcaggggaaaaagucagaauagauauggacauaauuacaugaacaacaaagcucugauuaguaaaaugagauauaacauuuuuggagcacaaaaucagaaacuuccugacuucaccugaaaggugaaauauauuccaaaauaauucucagaauaaucaaauauuugaguauauaaaacaaguucauauaaacuagaaaaaaauauggauuaaaaaaauuccagcugggcacgguuguucaugccuguaauccuagcacuuugggaggucaaggcgggcggaucacuugaggucaggaguucgagagcagccuggcaaacauggugaaacccugucucuacuaaaauuacaaaaauuagcugggugugguggugggcgccuguaaucccagcuacucaggaggcugaggcaggagaaucgcuugaacccaggagguggagguuguggugagcugagauugcgccauugcacuccagccugagcaacaagagcaaaacuccaucucaaaaaaaaaaaaaaaaaaaaaggccaggugugguggcucaugccuguaaucccagcaccuugggaggccgaggugggcagaucacgaggucaggagaucgagaccauccuggcuaacacgaugaaacccugucucuacuaaaaaaauacaaaaaaucagcugggcaugguggcgggcaccuguagucccagcuacucgggagucugaggcaggagaauggcgugaacccggaaggcagagcuugcagugagcugagauugcgccacugcacuccagucugggcgacagaguaagacuccaucucaaaaaaaaaaaaaaaaauacagauagauuucuuaacauaaaugcaaugagaaauacuguuauguaaaaaauuuuaaguugaaucaaaaacacuaaaacaauuacaaagcagaaacaaacuaggauaaaauacuuguaacaauacgagaaagugguuacacuuuaauacuuaauaugacaaaggguucccauaaguuaauaagcaaaacaccaauagaucacucaaaacaucagaaaaggaauacacaguuaaaucacaguaccauaacuggcuaacaaaaaugugaaaauguucagccucacaaguagucagagaaacacguuaaaauaaugagguaauauuuuuccauuuaucaagaguugaaaaaauucuuuauaagugauaucagaguuggugaggguuuagagaaacugucuuucuacccugcuagugguuggaagaaauuuaacaaucuuuuagugaaagagccuuaaaaaugcuuaauguguucucauaguaaaaccacuucaaauauuccacauaaggaaacauuaagguguucaucucuguguuacuuuuaacagugaaaaaccaaaaauaaacauccaacauuacaguaaacaaaaaacacuguacaauuguguuagauggagucauguaaaaaaaaaguuucuuuuuuugaggcagggucccacugugucacccaggcugaagagcaguggcgugaucauggaucacugaagccuugaccuccugggcucaagcaauccucccgccucagucucccgacuagcugagacuacaggcaugcucuaucaugucuggcuaauuuuuguauuuuuuguaaagaugggauuucaucauguuucccaggcuggucuugagcuccugagcucaagcgaucugcccaccuuagccucccaaauuauuagggauuacaggcaugagccaccacacccggcccaaaaacuguguuuccaaaaaauacugucuauugugugugaaaauguucacacuguauuuaaaaaaauaaaacuaugagcaauauggccaaaauuuuguaaaauauuauuuauacacauuuauuuuauauauauaugcaaaaagacuggaaagaaauauauuaauauuuuaauagugguugguuauauggggugguaacauuagcagguaauuuaauuucuccuuuauacuugugcugccuaguacugacuaaguaaggcaggggcuaggaagaggacugaucaaagcacaauacaugccuucuaagugcucacaguaagaauaguauagcaagguagaggaucuaaaacuagguuuggauuugaguucuaugucuucuaaacuagcugcuuaauuguacaagucucauuuucuguaaaauggagauuuuacacauuuauuaccauuucaauaaauacugacuucuguucucugcuagauccuuggacuacagcagacuucaugcaucuccuacuuuaaugggaaaggcagggacaggcacucaauaaguaaauacgaaacauuuuuuaaaaugauaaauggugggugcuauagaagauacaaaaagugggauuuaaucuagucuagcagguuaggaaaacuucuugaggaaguagugcugaaucugagauuugaaagagaaguagaaguaaacuaaauaaaaugccauagguauuccuuuguaagggaagaaugcauuucaauccauggagucuggagauaaaagaagucaaauaaugacugcaggguggagagggagggauggguggugaugguaagaacuacugugguuuguuaagaauuagguugcagagagcuuuguaaaacauuugcaaagucagaauuuccuaaggacaaugggcaaucacugaagaauuaagugacuuauacaagaucacauaacaaaugaugaagcugaaauuugaauucugggaagucugacuccaaagcccaaagaauauacaugaaaaagucccuaaaauagagcuugucaccaaaauuaacugauuagauaacagcuaauauuauauacuucaaugggcacaaagagaagcaaaagugguaaaguagagaugaagaagagauaaaugaaagauauucaggagaauuaauaggauuuugugaacugacuggaugcaggauuucuaaaggagaugaagaagucuaaaauuacuucagauggcuaaaauuuucauauugccucucagacugaaagaaaaauagagcguucacauucagauacauacacaaggcaggaauacagaauuugauuuuuuuucacagugugccuuauuuugguccuacauuucugaguucucaggacagagugcauauaccugguuaaauacaaaacugaaaaacugaauuuaaaaauaaacacuaugaacaucaguuacuagcauuucaaaacacaauaaauuuacuuuuagagugcuaccuggguuuuaaacauuuuguacagcuuuucauuuuuuagagauuguagauguaaaaaaauaaaacuagagauaaaugaugauaaacuggauuuucucccuacaaaacaaacauuugguuuaaacuuuauuucugguaaacaugccaacauagaacauaaaauuccuuuugaaguagguuccuaugcuucauggugaaugaaaagaaagcaaaaauuucaaacaaaggcauauauaaguaaaaaccuuugagaacuaauaaaauuaauccuuacauguguguuccaauuucuuugacuucaugauguaugacaucaucaauacaacaauccgguuuaaguucagccacugcagcauuggaggcugaaagauuuaaacgcugagaacuugucugaagaucagccuugaaagaaaguuaaaaaaaaaaaaaaaguccaaaugagacugguuaccuacagggugugcauggcuaugaguggaaagaauaggggaauaagaauuaggaaagaaggaugaaagggggagcaacacuuuuauguguaaaccuuucuguauagcucugaugcuuagaaccauggcaauggcacacccccccaaccccaaaaaaauaaauaaauaagaucaagcaggaauuagggagaauucaaaauggaauauaaacaguaacaaaugaaccuaacugcauuacaaaugaagaauacaaucgggcuauagcagagggaaggguaaaaguggaacuaaccuaaguaaguuuggaaaacaaaaucuuaacuguaaucuauggcuaaagacaaaaagaaugguacacaaauauacucuagcuacgacacguguuuuuucaccauuuuauguguauacuaggacaaaacaaaauaauacauuguggauaacaagagacagguuucuuaccuucagagaaaaaaaaagguacaaauaaggaaggggggaagcuacaaugguguuggacuggaauuugaggcaucaguaugaacacaugguuuuuaaauauauauucagauggacuucacugaaacaaauagauauguauguaugugcuaguauauaacacuaaaagauaaguaaucguccaaaacaaaauuagaugucagagaucaauucguuuauaagagaacuagaaaaugacauuaaagccaccaacuaagaaagcacuaccucaucuaaaguagcacuuucccuccacccgaugaugcuccauuauauuucuuuuuucuccuuuugaacauuuaucacucugucuuaaaacuacccucccccuuaucucaauuacuuucuaccacauucaacuuuugcuuccuuuguaacauuuaucacaaucuauaauuaccuuauguaugauuuuguuuaccuguuucuuucugucuccccuaccagaaaagucuauggaggcaggaaccucgucuucucuugcucaccacuauagcauggugccuggcacauaguaggcaauuaaucaauauuuguugaauaaugaauggaugaauuuaugauaaaacuuccaaggcaaaaaaaaaauugagggaaagcaaagaucacauuaggucaugggaauuaguggagguuuuuacaugagaguuaggauucuuuuaaguuuuuguuucuuuuauaaaacaguuuuuuguuuguuuguuuguuugagacagagucuugcucugucacccaggcuggagugcaguggcaccaucucggcucacugcaagcuccaucucccagguucacgccauucuccugccucagccucccgaguagcugggauuacaggcaugcaccaccacgccuggcuaauuuuuuguauuuuuaguagagacgggguuucaccguguuagccaggauggucuugaucuccugaccucgugauccgcccgccucggccucccaaagugcugggauuacaggcguuagccaccgcgcccugcuaaaaaacaguuuugcaguuaauucuaacccaacaauuuuauguuagacacuuugaaaugggauauuuauuacugcugugucuuuuguuauauucaguuauaaaacaauaguagcucacauuuauuugguaccuauuaugugcaaggcccuguucuaagcauauuauucauuuaauccccauauccugaaguagguauuaguauuauccccauuucacagaccacagacaaugaaaccaaggcacagaaaaguaacaacuuucccaagguuauacaauucauaaguaauaaagcugagauucaaaauucuuuuuuuuuuuuuuuugagacagaguuucacucuuguugcccaggcuggcgugcaauggcaugaucucggcugacugcaaccucugccuaccagguucaggcgauucuccugccucagccuccggaguagcugggauuacaggcgcccgucaccacaucuagcuaauuuuuuguauuuuuaguagagaugggguuucaccauguuggccaggcuggucuugaacuccuggccucaggugaucugcccgccuuggccucccaaagugcugagauuacagguaugagccaccgcgcccagcccuaaaaguuuuuaaacauuuuuuuuuuuuuuuuggagacggagucucgcucugucacccagguuggagugcagcagcaccaucuuggcucacugcaaccucuaccucccagauucaagugauuguccugccucagccuccccaguagcugggauuacaggcaagcggcacuaagccuggcuaaauuuuguauuuuuagcagaaacaggguuacaccauguuggccaggcuggucucaaacuucuggccucaagugaucugccgccucgggcucccaaagugcugggauuacagguguuagccacugcgcccagauauaaauucuuaaacauuuuugaaauuagagaaaaaaagaaauaauugaacccauuggcuuucuguugaauauguuuuccuguguguccuaugugucauuuuaaucauaacugcaguuuuuugauaaguaggauuugaaaaggcaaagaggaaagggguugggggaacuuauucuaaguaaguugaacagagcuagcaaaauaccacaagugugaaagcucaagaugucuucagaggacacuaagaguuugguauaauuggccaggcauuguggcaguuuccuguaaucccagcuacucgggaggcugaggcagaagaaucacuugaaaccaggagguggagguugcagacccauauugaaagggucuacuuggaaucagggaaaucacacccaaagaccaauuuugaaacauaaagaaaaaaaaucaccaggaccuccaggaaaaauuaugaaauaacuuacaaggcaagagaauuagacuggccucaauccucucaaaaacaacauacagagcugagcaauaaaggaguagcauuuucaaaaaacauaaggaaauaaaaauguaaacagaagauuuuaaaucuagccaaacuaaacuugaaguauugaaaaacaucuuugaacaagggcucagagaauauuguacccacaagaacuuccugagcaaucuacuugaauauuuuuaauauuaaaagcugcaauucacaaugacuaacaauaauuauaaauaugcaugaaacagcauagucuuuuuuuuuuuuucuuucuuuuuuuuuuuuuucugagacggagucucacucugucgcccaggcuggagugcaguggcacgaucucggcucacugcaagcucugccucccggguucacgccauucuucugccucagccucccgaguagcugggacuacaggcgcccgccaucacacccggcuaauuuuuguauuuuuaguagacacaggguuucaccguguuagccaggauggucuugaucuccugaccuugugauccgcccgccucggccucccaaagugcugggauuacaggcaugagccaccccacccagccgaaacagcagucuuuauaaagcaaaauauaugagauuuuagaauauauauauagaaauacacuaguaauaugagacaaacaugccacucuuaguauaagacggaugaaguuaacaauaaauauacagaaucuagcccuaaacaacacaauugauaaaauagcucuuaugaauauauauauauaucucuaacuuuacagccaauaauaaaacauauacauucuucucaaguacacauggaaaauucauaaaaaaucaauauugggucauaagacaucaucaguaaguuccauaagcugaaauauuacaagaacaacgcugauuggaauguaauaaaacuauaaauuauuaacaacaauuaaaauagaaaaaaaaaagccuuucccccuaaaaagcuuuuccauuaaacaacccuuggguagaaggugaaauacgacugaaauuacagaauucuuuaaaaaguaaugauaaaaauauaaaaaaaguuuuuaauuugggcaauucugcaaaguauuuucacauuuauuauauugucuuaauguaagauacgguguuugggauguucaacaaugcuacuaccucuuuacuguuguacaguaggcaucagcucuuucuuccaccaucaauuuuuaauuuuuaauuuauuuuuuaauuuggucucacuacauugggcaacagagugagaugcugucuccaaaaaauaaaaaauaauuagccagguguggugguaugcaacugcaguuacagcaacucgcgaggcuaagaugggaggauugcuugaaccuuggagguggaggcuacagugagcuaugaucacaccaaccugggcaacagagugaaaccucaccucuuaaaaucaaaaguaaugagaauaaaaaugcuaugcauuugaaucuucaggauauaaaaagcagugaaucagaggaaaauuaacuuuuaucaauauaaaucaaagaaucaaaauaaaagaauaaaauuccuagcuaaaaaaugguagaaaaagaauaaaguaaauaaacagaagcauaauaaaagaaauagaagcacaacuuaaagagaauagaaacauaugggauauaaguaauuuuuuaagucuuggauuuuuuuugaaguuaaaauacacaaaccaagagcuagcuaacuuaaucaagaaaaaaaccaaaccuaagaaaugaccaggggaaaauguugcaauacaagaaauuuuuuuuuuuuuuagauggagucucacacuguugcccaggcuggagugcaguggcacaaucucggcucaccgcaaccuccgccuccuaaguucaagcgauucuccugccucagccuccugaguagcugggauuacaggcacucgccagcacgcccagcuaauuuuuguauuuuuaguagagaugagguuucaccauguuggccaggcuggucucgaacuucugaccucaggugauccaccugccucggccucccaaagugcugggauuacaggcgugagccacugcacccggccaacagaagaaaauuuuaagagccuacuuuacagaccucuaugcagauaaaugugaaaaucuacaugaaaugaaauggauuauuuccuagaaaaaaacagcuuaacaaaauugacacccuuagagauaaacugcuuaaacauacuauauucauaggaaaaaaaaaaaaagaaaaaguguuaucagggagcuuccccauuuuaaaaaagaaaagaacuagcucauaugauuuugcagggaauucuacaaaucguucaaagaauagguaaucuaaaugauccacaguucucuguauuuguuuugucuuguuuuuuuuguuuuuuuuuuuuucucagacaggguauugcccugucauccaggcuaggaugcaguggcacaauuauagcucacugcagccucgaauucaugaguucaagugauccuccugccucagccucccaaguagcuaggacuacaaguaugcgccaccauggccagagaauuuuuaaauuucuuuuuuguagggacaucgaucauuauauuccccaggugaguccuggggauccuccuggauucaagggcuccuccugccuuggucucccaaagugcuggauuacagccaugagccacugagucuagccugaugcacauauuguuccaaagcacugaaaauacuggaaaaacauccgaaaucuuuuauuaagcaaccauaauacugacaccuaaaaccugaucaaaagacaacacucacacaaauacaggucaauaucaagcugugcuucaugaccuauauccucuuaagugauucugaugucacaauuggcuuaucuggccagauaugguggcucacauguguaauuccagcacuuugggaggcugaugcgggaggcuugcuugaguucaggaguucaagaccugcuugagcaacauagcaagaccuugucucuaaaaaauauuaaaaaauuagacagggauagugucacaccccugcaaucccagcuacucaggaggcuaaggcagcaggaucccuugagcccaugaguuugagguuauagugagcuaugaucaugcuacugcacuccagccugggugacagagcuagauccucucucaaaaaaaaaaagaaagaaaaagaaaaauagcauuauuauauaucaugagucugaaugucuaguugagccuaagaccccuagugaguacuacacugcuuauaauuauuauuauaaaagugaauaaaggcaugaaauauaaaaucauguuuuagaacaugcauacuacuguauucuuugaucuuuauaguacugacaucuuaaaguauaugccuuugcuauuuuauuaaucucuuauaaaaauaaauucaauauuuacugaauuuacugaauugccaguauuuacugaauuccaagaaauucaauauuuacaacauagaaagacaaaaguauauguucucaaacuuuugaaaaucagaucuuuucacaaucgaauguagagguuggcaagcuuuuucucugaagucauuagcaaauauuuuagauuuuagaggccauacaaucuccguuucaacuauauacaacucugcugugguagcuggaaaucagccacagauaaaacauaaacaaaugaguauggcugugugucaguaaagcuuuauuuaaggacacugacauuugaauuucuuuuuuguuuguuuguagaggcggugccuugcuauguuguguaggcuggucucaaacucguagccugaagcaaucuuccugccuuggcucccaaagcacugggauuauaggcaggagccaccacaccuggccugaaauuugaauuucauguaauuuucacaagucacaaaauauucuuuucaauaauuugaaaaugugaaaaccauucuuaguucaaaagccuuauaaaaacagacaauggaccaaauuuggucuuugggcuguaguuugucaacuccuaauuuaaugaaaggcagagaccccauccauauaugacaaacauauguacguguaugcacaaauuugcauccaguuucuggaaguugggucuauuugcucucuaacguccuuguuaacuuuaaaacucuaugaucauuuucaaacucauucuaauuagagguccuuuuuggaauacuccaauuaccugaacucaucacucuaagacagguuuuacaaaaaccucucccccacauacugugaguucuuaccuucuuuuugcucuuuuucuuuugaagaaauuucaggucauuagcggaguuagcauauucuaucuuuuaauuucuacacuacuucaaaggucuucuaacuguuccauuuucuacaaagcaucccacacaaugugcucauaucagucuuucuaacacaaagagugcucaaaagccaacugccugcuguuuuuuauuuaauuuuuuucagugacaggucuuguucuguagcccaugcuggagugcccaggcaaaacucaaugcagccucaaacuccugggcuuaaacaauccuccaguuucagcuuccugaguagcugggacuacaggugugugccagcaugcucaacuacuuuuuaaauuguuuguagagaugggagucucguuauguuucccaggcuggucuugaacuccuggccucaaguaauccuucugucacagccucccaaaguguugggauucuggguaugagccacugugccaggccuguuuuuuuuuuucuuaauuaauuuuuuuguccauuuuaaaaaauaauuuuucaaaaaagguuaaauaaaaccuuagccuggcuuucaagaugcucuauuguauggcuacugauaugguuugacucuguguccccacccaaaucucaucuuguagcucccguaauucccauguguugugggaggggccuggugggagauaauugaaucaugggggugggucuuuccugugcuguucucaugacggugaauaagucucaugagaucugaugguuuuauuuuuauuuuuugggggauggaguauuacucugucacccaggcagccuggagugcaguggcacagucuuggcucacugcaaccucagccucccagguucaagugauucuccugccucagcuucccagguagcugggauuacaagcacacgccaccacuccuggcuaauuucuguauuuuuaguagagaugguauuucaccacguugggcaggauggucucgaacuccugaacucaagugauccacccgccuuggccucccaaagugcuaggauuacaggcaugagccacuacgccuggcugagaucugaugguuuuaaaaaugggaguuuccccgcacaagcucucucucuuugccugcugccauccacgugagacaugacuugcuccuccuugccuuccgccaugauuguccccagcuacguggaacuauaaguccauuaaaccucuuucuuugguaaauugcccagucuuggguaugacuuuaucagcagcaugaaaauggacuaauacagcuacuauuccucuguaccaccuuacggacucuuaccaagugaaauuuguucacuguuaaaagaacacauguguaccacuaugucucugccucugauuaccaugucucccuugccuuguuaucuguauccucccauucuuucaagauccucuucgcauucccucucccccaagaaaccuuccagauugacauaaucuccagugaucuuucaucuuccauguuaaugacauacauuaacaaauacuaaacugcuauuuagcuuugacuaguacauuuucucacccaagcaaucacaaaucuuguggaauaggaaaaauguuuucaugccuaacauaauacuuuauaacuguaggcauucauuagugcuuguuaaugacaauuaaaaauuauuguaucaaacgugcauuuaaugaagugccaaaaacauaauagauauaaaaaaaccuuuuuuucuuuuuuuuuuuuuugagauggagucuaacucugucacccaggcuggagugcaguggcgugaucuuggcucacugcaaccuucaccucccggguucaagccuuagccucuccugccuuagccucccgaguagcugggacuacaggugugcaccaccacaccuggcuaauuuuuguauuuuuaguagagaugggguuucaccauguuggccaggcuggucuugaacuccugaccucaggugauccaccugcuucagccuccuaaagugcuaggauuacaggcaugagccaccaugcccggccuaaaaaaaaaccuuuguuaaagacuaaaauacaucccaaguaagaauguuacuuacuuuuacuaauaugucuuuuacaacuugauugcuaucauuaugaacgcugauauaacuggaaaaggucucucccaaaaauauauuccuguaaaauaaaauaaguauuuaggcagaaauccauucagguuuuuuuucuuuuuuuuuuuuuuugagacagagucucgcucugucacccaggcuggagugcaguggcacgaucuaggcucacugcaaacuccgccucccauguucaccccauucuccugccucagccucccgaguagcugagacuacaggcacccaccaccacgccuagcuaauuuuuuguauuuuuaguagagacgggguuucaccauguuagccaugauggucucgaucuccugaucucaugauccgcccgccucagucucucaaagugcugggauuacaggcgugagccacugugcccaucagguuuuacauuaaauaaucuguuugagaaucacuaagaacuucaaauggagaaacauuuacugaaggauagaaaucuggugaaauacugcuucaacauuccuuuguucacacuaggccacucauucauuaccuagugcaauucaaaauacagacguaaucuauagaacaugauauaucuuggccuuugacuacuguacaaaaugccaaccucacuagagauaagacucauugaaauuagaccuaugcuaaagucuuaggauuuguaucugaauagguuagagagagccaaguuuccauucuugaaauaacuuauucccugaaucuagaagagaucuaaguuacugauauugggguauuuuuaccaauuuauuuuauuuccuagguuacuugaauaaaaaucaccagugguuuuauuuuaguuuuauacuuuuuacaugaauauauuucccaguuuuucaagacacuagucaaugaccacauucuguaaaacuauaaaaacaaucuguaaaauuucuuuuugucucaaauucugucuguugcaaacagaguggaaccaggggcuucuaccuuauuauuaaucuagaauaauaauacagcuaaggauaacagaagaaauaaauuuagaguuccuaauuagcugacaagucugauaacucauuuugggagaggacuaugaugcaaaaaaacaaagacuggcuucugaaaaagauguuuacauuaguaguuaaaagacuauguggccauuacaaaauauaguaagaucuaaagaagaaaguuaaaauucuauuaugcuaggaaccacuauuaacauuuuauuuugguauauaucuuuuuuuuuuaauaacagaaagccauaaucacauaguaugauuuuuuaauaauauuuuugccccucaaauguaucauguccuaggcgugguggcucaugccugcaauccaagcacuuugggaggcugaggcggguggaucaccugaugucaggaguucaaggucagccuggcuaacauagcaaaacacggucuccaauaaaaacacaaaaauuagccagagcggugcgcacgccuguaaucccagcuacucggaaggcugaggcacgagaauugcuugaacccaggagguggagguugcacugagcucaaauggcaccacuguacuccagccugggcaauagagcgagacuccaucucagaaaaaaaaaaaaaaagguaaauguaucaugagcauuuccccaucccaugguucuguuuugaaaacauaauuuguaauggcuuuacaagguuucuuaugugaauaugucauucuuacccaaaauucugugguaaagucagcauuucucccaacauuaaaacuucugcaccauuaacgguugaaggaucaucucucaucagcugguuaaagagaucuccugaaugaagagaaaaacauaaaauucuaacaucuacccuuuaaauaacuuuuacuuauauaaagaaauagcugggagagauauuuuaaaaaacaaccucuugacaaagaugauauuuaaaaagucuaacuucuagauuuuaauacaacaaagcaugucaaaaaaauucugaucucacagggaauggaaacuuuagaaacaaagaaaaauguacgucaugagauagaaaauauacuagagaaagccccaauaauucuuaaaaaaaaaagggaaugcuaauacauacauugaugcaacauuugaggauaaaggcaauuuuaauaguauuaugaauaugaauguaucuuaaacugucucauacugccauaggauaucaacauaauuuggacuuguagaguauaaguaaggccuguuacucagauggccaccuuucacaugauacaaaaauaggcaacaaagaauccagcaaaugguuagcauaaaauuuacagggcuaggcuuaguccaagguaaugcaggcaauucagguuucaaccuuucccuaggugcaaauagaggaaagcaugugccauaccagguaagucuuucucuucacauguuacugggauauuggugaauaaaguaggcuuagucagccgcaucacugugaaguaaaaaaguaaaagaaaacaaaacauuaauacugcuuaggguuaauauucucaagucuaguguaugacauucauccauuuuauacuaacauaaaauauaaccuaaauacuuccuaaauauaauacuacauacuuccuaagguuaucacacaucagugauuuauuaagaauuguaauguuacaaaauaagcaccauuuauuuacaaccuaugaauuauaaaaauuaaauguaaauacaauaugcauucauuauagaaaaacuggaaaauauaauuuuuaaagcuuaaagaguauuaggagcauaaggcuuuaaaaaaauucuaagugauuucaccauaaacaauaucaacaaaauauuaacuuuggaaacucaguaaguguuuuuuguuuuuuuuuugagacaggcuuacucugucacccaggcuggaguguaguggugcgaucucggcucacugcaaccucuaucucccagguucaagagauucuccugccucagccuccugaguaguugggauuacaggaaugcaccaccaugccugguuauuuuuuuuuuuuuuguauuuuuaguagagacgggguuucaccauguuggccaggcuggucccuaacuccugaccucgagugaucugccuaccuuggccucccaaagugcugggauuacaggcaugagccaccaugcccggccaaguguuucuucaaguaauauuaauucuguguagaaauuacaaaaaugucagaaaacauauacguuuauauaauuccaaucaaaaguaagauauuauuuuuggaacaugacagaaugugucuaaaguuuauuuagagaaacaaauaaaugaaaauaagcuaaggaaauuaacggagaaaaaagaggaagaacugaauuuacuacauauuauaacauauuuaaguccauaaucaacuaauugacuuauuaauauaagaccauaccgauauauuaguuuuucaaaaaaaagauaggauauacuuauauaaagaaauugcugggaguggccaggcaugguggcucacgccuguaaucccagcacuuugggaggccaaggcgggcggaucacgaggucaagagauugagacuauccuggcuaacacggugaaaccccgucucuacuaaaaauacaaaaaauuagcugggcgugguggcgggugccuguagucccaguuacucggcaggcugaggcaggagaauggcaugaagccgggaggcggagguugcagugagccgagauugcggcacuguacuccagccugggcgacagagcaagacuccgucucaaaaaaaaaaaaaaaaaaaaaaaaaacgcugggagagauauuuuaaaaaacaaccucuugacaaaaaaaaaucaauuaaaggauuagaaguuaaaaaaaucaauuagcaaaaggauuauucauuauaaggugcaaagacaugguuagcuaucugggaaaauaaaauuuaacuaaaaaauucacuuuaaauauaaauagacaaaaauuaagccacagaaaaguaaaaaaaaagaaauugaauauuuauuauagucuaaugaguaaacacucuauaauuuuuuuaaaaaucuuuuucaguuacuucuaaagacugucguuugaccacaucaaaauaaaaacaaaaacauaaaauuaaaaaaucauaaaaacuuguaaaauuuuucagaaaaugaaucacagagggcuaguucauuauuaaaaguauuccuucaaaucuggcugggcacaguggcucaugccuguaaucccagcacuuugggaggccgaggcgggcggaucacgaggucaggagaucgagaccacggugaaacuccgucucuacuaaaaauaaaaaaaauuagccuagcaugguggcgggcgccuguagucccagcuacucgcagaggcugaggcaggagaauggcgugaacccgggaggcggagcuugcagugagcugagaucgcccacugcacuccagccugggcaacagagcaagaccccgccucaaaaaaaaaaaaauuccuucaaaucaaagccaaaauacuauaaagacuauagaccuacauggucaauucagaauauaaguaauguucuagcauauguaaaaauguaccacccaacuacuaauuaaccaacuauggcauucauaucaaauuuaguggcuuucucauucugguuucagcuuaaaugucaucuuuuucagaaaaaaaguaacaggucauucuguuucacucaugguaccuuguauuuaucaugcaguauauuuauuuguuuauagcacuccuuuccaaacuccaugaggucuaggcucuuauguacuacguucaguuuuguagcauccauauuugguguaaguucugcuauucagaucuucccugaauaaaauaauuagcacuucaugaaagucccuaaauaacugacauuauuuugaaaguguaaguuucagaaacugaaggcaauuaaaaaccugcuauauuaagcagcuggcuuuugaaauagucaacaaaugcuacccuuaaaauuucugaaguuacucuguauagcuagcauuuacugagcauuuacuagcgccaggcauuaugcuaaauauuuuacaagcugaacacauuuaauucucaugaguacucucuaaguugguauuacauuaaccccaauauacagauagggcauugacaauaccugcagaggguaauuugcauacaaaggauuauauuaguagauaagugguagaaucuagauuugaacccuggugauuucacucuguugaaaaauaauucucuauaauaauuauuaauuauaagccuggagccauaaaccuggaaugucaugccuuaccagaaauaccccaugggaauucaaaguaggaauguauuccaaagaguauuaaucagcuacagaugaauauggggaggcguuuccaaccuucacucuuauuuuuaacuacgaaaacagagaaaaaggugcccugaaaacagauaaaaaggugcccugaaagugauacacaggaggcaguuucucccaauuuaaacagcuaaaaucacuagacagggucucauuuuguuacccagguuggacuacaguggcacgaucauggcugacugcagccuugaccuccugagcucaagugaaccuccugccucagacccacccccuacccccgcccaccaagaggcugcgacuacugucgcaugccaccaugcccgguuaauuuuuguaguuuuuguagagacggaguuucaccauguugcccaggcugguaaguucacuuuuaguaccaguugguguuuucuauuucuucccuauuauuuuuuucauuucauuagaaaacaaaucugaauaaagagaaaauacagucucaagggaauccugaaacauuccuuuuuuuuuuuucuuaguguccuggaguucacccaaacauguagcuaacauauuugcuuauuauagguuccaauuucuauuauaaagaaaaguccuauaaagcuuaguuuuucaugauuccugugguuuagcaggggaugagaugguggguaaaaaaugauccuccauuaaaaauaaagugaucccaacuugguauuaaaagcaacuuuuuucuucauauuuucagauuauggccuuugcagcaacguagaugcaacuggaggccauuauccuaagccaauuuaugcaggaacagaaaaucaaauaccacauauucucauaagugagagauaaacaaugaguauacauggacacaaaaaacagaacaauagacacugaggccuauuugaggguagaagguggcagggggugaggacuaaaaaacuaccuauuggguauuauccugauuacaugggugacaaaacuauuuguacaccaaaccccuguggcacacaauuuacccauaucacaaaucugcacauguaccccuugaaccuaaaauaaaaguuagaaagaaaaaaaaauuagugggcuuccauuuuaagcaaccucagccaucucaggcuaugaagaaucccucugaagggaauguuuaccaugcauuaucaagcuccuaccaugacaggcacugagcuucaagguaaacaugucuauauuccuaguuaagugcagucuuauuuuucuuagggagcugguguguuuaauaguaguaaugacauguaagcugugugagggcaagguccaugucugucuccuucccuaguauauccuagcaccuagugcaaaguaggcauuuaaauauguuaaacaaacauacaugcuucuacaaaacuuuuacuguuuuaaucccuuugagcauuuuuaugaggugauguguaaaaccaauuacaagauuaugcuuauggggaaccuacaaugacuccaaucaucagccaaguaauaauuagcacuaacuaucauuaauacugaauuaucuguauuagaagaaauaaacaaucauucaacauuugauacuuuccuucaaaacaggauacauuaucguuuuaggcaaaguauacauuuuguaucguuguuugaaaacagccuaucaauuguuauuacauaucuuuggaaacaucauuauaaaucuagacuagucucccacuuugaacuacauucaugccacauaaauagcacuccaaagagaauuguuucgaguuuuauuuuuuaaaaaauuacacuugagguaaggaaaaaaauacaguaaaauuagauuuuagagauuaaccaaaauccaaacuauacaacuuaauucaugacuaauucaaucacaguuuguaacaaaaggaacagaacauuuuuaccuucaaauucaguguaaacaauaauuuaucacauuuaaaagaaggcugccaauaagcagaacucagcaauuucuugacuuaauugacaagccuaggaauucuaaaaagucauuaaaaauuuuaaaaccuguaaaaauuauuuuaucuauuucaauccauauucauuucauucagaauauucuuuuugacaaucaguggaauucauuacauacuaaaaauaacaccauauuuaugcacaaauaaauuaauuuuuccaguaagagcuaaucuuccuuuaagaagacuucccacauauucacaauacauaauaucacagaacacccauauuuggccuaaaugccucugaauuguagcauuacaagauggaaguucauugugccuaauaauuugauugaguuuuguccaaaugucuuccagaguuuggcuguuacaaauaguguguucuauuguccaucuugcucuauaaagugaguguaaauuuagugccuuuaaacuaucuugcaauuuuuuagacaaaggagaaacguuuuuaguacaauuauugcugggaagggaaauacuccaagaucuccucuugugcuguuuucccuuuucugauuguuuacccagauuuccagaauuagucuguuccuucagugugugugaccagguuaaaugcugcuuuuucaagcuagguugaaacuccaauagaucuacugugcaaucauaacugugugacuuagcaucauguucugaaaugguuaaguacuguuucacaucuucagcugccucuucagaaaucacagguggugaucuuuuaggucugaguggaagcuuggacccaucauauggaaaccaagguauaaaucuugauagcggacgaguaggaaagucuugaauugcuuuuucugcaauuuuuggcaguugugugggaucacucucacauggucgauaauguaauauuacuucuguagucauucugcaguaauccaguuacucuuagugaugagaaaauuucuuaguugaacuccucagagcuagaauguuaauuuauuauugcaagauugucucucuugccaaaucagagggaaacaggaccuaaaguagaaguauugcaaagaauaagauaugguagggauacccugccuaccaacaggcagggagaaaaggaaaaacaaaaaacaaaaaccaaucccaaugugguauuuuaccaaagugcuauugguaaaugugaauguaaucuacaaaccugaaaauucuuucucuuaccaaaauaagggaucugaacuagaugcccuauaaaaucacuuccugccuaaaaacgcuaguagucaacauguuuaacucaauagauauaaaggacuuggaaguaucgauauuaauauauuaaguaauaauagucuuaaaacuuuagcagaaacaaagaguaaaugaaugauucuuaaaauauuguuuucauaugaauuaacaaaaaauguaauauuuaaaaauuugaggcaacuaaauugaggacaaugaaaucacuguaaauucuaauccaacauggugaaaacccaucucuacucaaaauacaaaaaaaaauuagcugggugugguggcgcaugccuguagucccagcuacuagggaagcugaggcaggagaauagcuugaaccugggagccagagguugcagugagccaagaucaugccacucagccugggcgauagagcaagacuucaucucauuaaaaaaaaaaaaaauucuaaucugucuggaagaaaauuaaucauuuuauacuuaaaauuauguagauuugccaggugcgguggcucaugccuguaaucccagaacuuuaugggggccaaggcgggcagaucacgaggucaggagcuugagaccagccuggccaacauggugaaacuccggcucuacuaaagauacaaaaaauagccggcugugguggcgugugccuguaaucccagcuacucaggaggcugagggaggagaaucgcuugaacccgggagguugagguuugcagugaacugagaucgcgccaucguacucccauugcacuccagccugggugacagggcaagacuccgucucaaaaaaaaaaaaaaaauuauauggauuccaccaaacaaauauauagauagaauauuugaugauuucacgucauucucuguaguaaaaacuaaaaccauuaauaugguuuaacuuugcuaauaugguuuaaccaggcuaagaaccaguuuugugacacugucuucuccucauaauccaggcaauuaaacaguauggagaccccaauaccauggcuuuugaauuccaguuuggaagagaacaagaagucuagacuccuauuuuuuucucuuagagcacagaaguccucaaguugccccaaauuaagucacugauaauaaauuccagcauauggugcauaggcucaagaauggagccuuccaauaucugcaaguuaggcuugcuaaucaggcccaaagcuguaagagccauaaaacagacuuuuucacauccuaacaacagcagaaaaaaauaaguugaaucccuucuccccaaaaaucauuagagaauuacuugaugaggguucucccacugcuaggauaaccaugaguauggauucuugucaucauuucacaauagaaucacugucugauucugaagaguuagaagaaauaauuucauuauuuuuaccuacugauacugcccacuaacagaucugacaacucucaaauucauaaauaauugugaucuuuaacauccauauuuuaaauauggaucuaaauguuaucauauauacuuucaagaacuaaugaugcacuaauguuuuucuucccuguuccuuauacuuucacauuguaaaauauggcacugagaaauucucuuguugucuaaagucaaucaguguuauacucaagggaugacuuuuuuuuuuuuuuugagacagagucuuuguugcccagguuagagugcaguggcacaaucucggcuuacagcaaccuucgccucccagggucaagugauucuugugccucagccuccugaguagcugggaccacuggugcacaccaucacgccuggcuaauuuuuguauuuucaguagagacgggguuucauaauguuggcuaggcuggucucgaacuccugaucucaagugaucagccaccucacccaaccaagaauaacaagauauuaucuuuaacauuuuacauauuaaaagauaaagugaacuuaaaugaccacuuaaauuaauacauuuggcauucagcaucagcacauugaaaugugugaaaauuguugauuaacuagaacaauggguuaacuauaagaugguacuaaagagguuuaauaaaguugaaacuaucagucaauuuugaagcacuuguccguuuaggcugcuuauuguucuuuuuuuuuuuuuuuuuuuuuuuuuugagacagggucucacucugucacccaggcuggagugcaguggcgcaaucucagcucacugcagccucugccucccagguucaagcgguucuccugccucagucucccgaguagcugggauuacaccaccacaccuggcuaauuuuuguauuuuugguauagacggguuuucgccauguuggccaggcuggugucaacuccugaucucaagugaucugccagccucggccucccaaagugcuauuacaggcgugagccaccacgccuggcuuaggcugcuuaaauauucuuucuuagguauccuugguuuuggaaaaaaaagaauaacagaaaacuaaaaauucccaguggcagucucuguaucacuggaauuuaacuuuuuguuuguuuguuuuuugagauggagucucgcucuguugccuaggauggcgugcaguggcgugaucucggaucacugcaagcuccgccucccggguucacgccauucuccugccucagccuccugaguaacugggacuacaggcgcccgccaccacgccuggcuaacuuuuuguauuuuuauagagacgggguuucacuauguuagccaggauggucuugaucucuugaccuugugaucacccgccuuggccucccaaacugcugggauuacaggggugagccaccacgcgcggcugcaauuuaacuguuuuuaauagcuucuaauuuguauaaaucacacguagcaguuaauagaacuguuccaaauucccaucggaguagcugguagaggaauuaucucugagaaugcugcuucauucuuuaggaggcaacacggacucuuggaaagagaggcaggccuugcguugaaacacugccucaaucacuagcuaugugaucuuggaaaaguuacuuaaacucugagaauuaauauuuacuccacauacuugaagugagauugugagauaaagaacacgacaauuaguugcuuuucuucuuuucccucuucuccacgaguaacaauccauuuuaaucuccauuuuagucuagaucauuugcucagguuaagcuuacaggucccaucacuguaucacuaaacauuacaaaguuccacaguaagagacaaucucgcuaacacaggcaucauuauaugagacugaugagcuucuagaaagucugaugacuacaucauaaugggaaggauaaggcguuccucaaaauggaugccauaaguaaaguaagcgcaauucaauugaacccgaauguuuauugagcauuuccucagcucauucaagaagucauuguuaaccauauauuaaggcauccaagaaacaaaaagcgcauuuguuguaguaaaaaacaaauaaaauaaagcugaaaagauuucaaauaaaagguuuccagaaaauaggcauuaaaaaaauuguccuaaaaaaaaaagugcugcuguuuuuuccuaaauaaugaucuaauuaaaucaccaaacuuacucaaaauggcuguguacaaaaaaugagaguugacauuagaucucggacauauuucccacauacacagugauuugaaguaaacugcaguuuguuuugaauaaaucuaaguuauauguuguauuacuauguauugcuaaauucucugcacuacugucaugcaauacuaauuuuacaggggaagcugaagccugauuaacuucgucagugccacaggaagaaacaagagacagaaggaaaaagcacuuuggaugcccgcuguaauucacagagaucuccacgguaggagcgggacgucagcuucugcggcuaaaaucucgugacugaagcagcacagaucagaaagaacgauuuaccagguaucuauuucguucuagaaaggggcccauaaaccuaaaaagcauccaggagaaaucgcuuccucccgcuuggcggcaaaggacagagcaggagggcgagcacugaguguuuaagaaggaugaggccuacauggcaaaggcuucgauaaguagggaaugcaaggaaacagaaaagggggaaucagguucgcaaaaguuuaccuuuuagcgccagcaggugcuccuguuuagggggauucacuuccauuuugaccggcacuuuugacccacagccuacgggggcuggacagguucaacuugccccggaaggaaacggaaaaccucgcguuuggcaaaaccaaaagucaaacgcacucucaaccucucucugguggugguaccuuaaauucuccuacuguguccuuuacaaacuggcuucuuuucaacaaguccauuucuucuaucuuagaaacguaggcauaaaauacuuuguuuuccaucugcaaucacacaucgcgacugcaggaaaagaaaccaccccuagguaacaauacgcggccucccaaaggccaacguugccggaguuuuuuuuuuaaaa

SEQ ID NO: 192457 - RNA, 59897 nt, Homo sapiens
acugggguggcgcgcuaccucugcggagaaggaucugacaguguuccggagccggggcgagcagccaaaaggcccgcggagucgcgcugggccgccccggcgcagcugaaccgggggccgcgccugccaggccgacgggucuggcccagccuggcgccaagggguucgugcgcuguggagacgcggagggucgaggcggcgcggccugaggugaggaggggccgggugcugggucgcguagcuggaguuagagugucggugguuucggacgggcuaucuggcacucgaggagaccucccuucccccugagagcagcgcccggaacuugucagcccagccuggaaauccccacauuccuuccccuuccugcucccggaccuccgaauucuacuuccacaacuuugucaccucgauuaucgcagcccugaguacaaacuucacccaggcgcacgcacgcaccccucuuaacgcccgccccgcagaacgcccuucaagaacaaaccccccuuuuuguuaccagaucccacguuuuucccaauccccuuuucaucuccccugaaauucuauucgcuccgcacuugucuucauucucgagguggauuucccuuccccaaagccguuuuuucaucuugaaaucguaacguuucagcuuuguugaaaguucacaaugcuuauaaacacuauuaacguuucuuuccuucuuuugaucuuuucuauuaauaauuaucauuccuaacgaauuccacaucucacuguaucccaaggagaacaaaucaguuuuuaaaauuuuaccuccuccgaccuaaacuuuugaagauagugcaggaagcaagggucuguucuucaguggaugaacagcauuuuauuucauaauccgaaacugaaaaaaaaaaaaaaucacagguuaaaaauaagacgucaccuuuuuuuuuuuuuuuuuuuuuugccuucagaaggaaacgcauuuuggcuuaguuugugaaguauuucaacaauuauacugccuuaaaauaacuaguuauuagaaugccagggugaauuuucugaaagauugugguauuugcuuuugacagugcuguaaacaaacccuuuaaacuguguaugacugccagcuucaaguuggaacaacucuuaauuugaaauuacggacucagaucaucaguuuagcugugugccauuauguuaauuucuuaaauucauguuaauuccuauuuggaaguauuuuugaacuaugaacugaaauauuacauuuauagaaccaacuugcuauuaaauugugcuuuccaacuauuucucuuuagggauaaucuugaacguuuguuuuuaaucuugagugaaagaaaaaaauuacaggaaggagaaagugucaaaaaggacagacuguagugggauuuuuuucuuauuuuaaguauguauugacaauaccaguuuaauuuucucacaggcaauuuagauuauuauaaauacugcugccaccuaauuuaauauaauauagucuuacguaacuaaaaauguuguucucacucuuauuugugaauugcaguauuuucaauuuauuuaaauuuguuuccaaggcuuugcacuucaguucaguguuagggcgaaaguuaaauacaugugaaguagguguuaaaauguccccuuuauagagaaggaaacaggagucucgcugaaaacuagaucugugugacuccaaauccugugcucugaaucauuuugucauguugacacguuucucauaaaaaccccagugccacaauuugguuugggaacuuaagggcaacccauaaauccucuacaguggcagggagggauuccccgcucccuccuuucagagcugcucauuuuaaugggagucagaauucucuggcccuaauacauuugcagcuuggcuccuagagaagcauggaauguucucacagcuucuccguuucuuugauugcaaaggcagaaugaucagaguugagguuccuauugugcuuuauuauuuuacacagcaaauacuaagcaauuacuaccugcuguacgaacucacaaaggugcaggagauguaaucaggaccuucaaagaguuuauaauaauuggauugacaaacuuauacgaaaaaaacuacaaggaugcaaagcaguuuuaauuaaaugcagagugaugcagaaaauccuguagauauuaaaauuagggaaugaucguuuaaggauuggagugagcauuuaaggauuggaaugagcaaaggauuuaccagaaguuggccuugaaaccuggguaggauuuggauaaagggaaaaaugaagacagcccauuaauaauagcgaauggaggacaaaauguagaauggagaauauagaacauaauauaggacuagcuuguggaaaggaucagcaguaacuaaggucuauuaauuaaaacaggcaauauauuuagugcuuauguugugccaguugcuguuuugagcacuuugcccauauuaaggcauuuaaucuucauaauauuaugaaguaggucuaauaauaauaggauaaaauccucuuuuuacacauagggaaacccaggcacaagaagguuaauuaauuugcccagcuaagugguagaucuaaaggucauacauagacagccuggcuucagaaucugaccucuuaaccaugauacauccugcgucuccauacaguacgcuugagcgacagcgaguagauagaaaauaagaucauaccagaaagucuauaaaaacccacccuuaauuguccaccaggugccucaaacuaugguagauucugaggauaucaagauaugugaaacaauuacugugcaguguucugaguccuguuagggaaugauguaagaguacacugacagcaaagauguuugaaguggggggaaauuccauauaagagaugauacuucaaaagcaguuuguagugcacagcagagucaggaaagacauuggaauaauauauguagaagcacagacugaaagaacaagguauguuagaggaagucuagugguuugcugagucuacagggaugguuaguagggagugaugaaagauaagaccgaauuauaaauggcaugguguggucaagcaaaaugaggagcuuaaguauuugcuuugcaguuuggaaacuacaagaauaauuucagcauuauuggaguaaaaaagccagauugcuugcaauugcaagcaguucucucuagaaguauaguaguaagguagcuugagggaggagucugaggaaaggauuuuuuuuuuuuuuuagaauagagaaacuugaguauuggaaaagauagauuggauaggcacaucaaagccaaaauuuuagguucuuaaauaguuagaauauuuggcauuauuauucacccuuuaaaaagcuguugaggagaagaaugacagguuuaaaguuguguuguagagagagugauccaccaacaauguucagaaugcuugguggggaggaaagagacuggaagcaggaacacaguugaaauuauugaggugaucaauguccaaauuagguuaguuugugguagagaguaaaaagaagagaugggugggaaagauauuaugggagagaagacaggauaagauuuguaacugagaaaagcuaaaauguacugcauagaugagagaaacgauggacuccauugacuuaggcaguugaagaggaugaguuguuuguagauagggaaaaaugguaaguccuugugacuuuuuaaaaagugugugggcauucaucccauuacugggcauauacccaaaggauuauaaaucaugcugcuauaaagacauacaugcacacguauguuuauugcagcacuauucacaauagcaaagacuuggaaccaauucaaauguccaucaaugauagacuggauuaagaaaauguggcacauauacaccauggaauacuaugcagccguaaaaaaggaugaguucauguccuuuguagggacauggaugaagcuagaaaccaucauucugagcaaacuguugcaaggacagaaaaccaaacaccgcauguucucacucauaggugagaauugaacaaugagaacgcuuggacacaggguggagaacaucacacaccagggccugucaugggguagggggaggggggagggauagcauuaggagauauaccuaauguaaaugacuaguuaacgggugcagcacaccaacauggcacauguaucauauguaaccugcauguugugcacauguacccuagaacuuaaaguauaauaaacaaaaaaagugggugggcauuuauguguauauguguucaugagcauguaccuaugguguauuguuuuuagaccucuuaaauugauaagacucagagacagaauaucuaagaagaugaaauguaacuggaauuaaaagaaagauccaagccaaaauucuugaaauuauuuuguuugaagguaguaguugaagucaugucuucaaagaaguugguauuuaaaaagaaaagucgaugcccaguacuuuaucuuuggguaccuucauagccuggagauaaaagcuagcagagaauucaguaaaggagacaagaaagaggauaaaggaaagaauucaacuacauuaucugguuacauagaaaccaggauauaggagaaauucaagaaccagggauggucaacaaugugaaaggcuucagaaacacuugugauauauauagucaaaauggcuacagucucuucuucuucuuuuuuuuuuaaacuuugcggcuaucuaguguaucuuaguaagauuuaauaagaaauuagcugauugaucgugaauaagagagcuacauuggcugaaaaauggcuauaguauauagaugauuguuuuaaagcuguguguauacauauccagagcaggagauucauuccuuucagcacuguaaaucuguugcccuguuacauuuggaauguucugccuccaaaguuucauuuucuuuuaagcaaucagcuucacccuuugcucuaagguugauugaucugcucagucuuuuuuuguuuggauguucuguuuuauguauuacccccaaccccacccccuagugcaaagugaguuaaucagagcuauguuucagauagcauagcucugguuagacuggcaugcucugggauuuugucauugguaaucuucacuugacaauuagagucaaagaugauguagaguucauaugugugcuauuuucucuaucuaggaaccccuacccuuauuuuaagacugggcgcuccuggccccugucugaauuggguauuuucugugcuccuguggcacuuugugcauauucugcaucucuaaacuuuggacuucuuaaaggcaagaacuauuuauauggcuucaauuauguuuguaacggaauaaaaauugaauaaaagcuugagcuuuuauuucuuaagcaauggugagaacauggauguucaucaaagugcucuguaaaccuuuucauuuggcuaaaauagucuaauuuuaaaaggcccuaaggucauaagcauauucuauguguuuuucaauaugcuuauaauuuugcuuuugcauuuagguccuuaaucuggagagagaguguaugcuuauacaugcaugugcacgugcaugagugugugucuuuuugucugaugaaaugggguucuuuuuuuucuuuuuugcuuauggagccaguugucccaauacuauuuauugaauaguccuuuauuuucccagcaaaugagcaaccuuuuaaaaaaucagauacuaaauucuuauauacacuugaguguguuuuguuuuguaccauugauuuaguugucuauucauuugccaaucagugcuauguuuacuuuaccuuuagacugcccuuuuuuuuuuuuucugcgagacuuuuuuuuuuuuugagacagagccucgcacuguuacccaggcuggaguacaauggcaagaucuuggcuucuuagcuugcugcagccucuauaagcccaggcucaagugguugucccaccucagcuuccugaguagcugggauuacaggcaugguccaccaugcccggcugauuuuuuuuuuuauuuuuuuuuuauuuuuuauagagaugggguuuugccauguugcuuaggcuggucuugaacuccugggcucaagcaaucuaccuaccucggccucccaaagugcugggauuacagccgugagccacugcacccagccuucuguuacauuuucuaauuaguuauuacugguauguaggagagcuuuuuuuuuuuuuuuuggagauggaguuuugcucuuguugccugggcuggagugcaguggcgacaucccggcucacugcaaccuccgccuacuggguucaagugauucuccugccucagccucccaaguagcugagauuacaggugugcgccaccacucccggcuaauuuuguauuguuauuagagacaggguuucucuauguuggucaggcuggucucgaacucccaaccucaggugaucugccuaucucggccucccaaagugcugggauuauaggcgugagccaccgcgccagcuggagagcuauuuuuugaugauguuuuguuugacuguuauguuaaacucuaaauaguccuauuauuuuuugaugauguuuuguuugacuacuguguuaaauucucaauaguccuaauaguuugucaugugauucucacucuuucuugauagaugaucauaucauucacaauuuauuuuccauuuuuagaucuuauuuauuauauuuuugcuuaagcccuuuagagcaguggugaauaacugaugacuucaagcaucuugucugaaucuugacauuaauaggaacgcuucuaauuuuuaccuuuaaaccuauagaugcuuauuauagguuucuuucuuccuuuuuuuuuuuuuuuuggaggcagagccucacucugucgcccaggcuggagugcaguggugcauucucggcucacugcaaccucugccucccggguucgagcaauucuucugccucagccucccaaguagcugggacuauaggugcccaccaccacgaccagcuaauuuucauauuuuuaguagagacagcguuucaccauauuggccaggcuggucucaaacuccugaccuugugauccaccugccucggccucccaaagugcugggauuacaggcguaagccaccaugccuggccuuguagguuucuuauaguaguaccuguggcagcaacagcaagagcugcacuaauaauaacagcuguuaaccuuuuauugaguaguuacaaugagccaaaugauucuaagcacuuuauguauaaugaguuauuuaaucaucauaacauuccuagauggguaggugguggugguaccccauguuuacagauaaaggaaguaaaagugaaggcuauuuaaaaacuugccuaagauguuaaaauauagggacugaaauuugaacacaagcaaucugguucuagagucccuguaucaucuuuguuauccuucaccaagguaaggauggucucuuucagucuuaguuuucugacacuuuguuguuauuuuuaaguuuuagaugaacaguuguugaauguuaucagaugcuuuucaaacaucuguuggaaugacccugucauuuuccuuuggucuguuaauauaguaauuagcaguaucuuuucucauuuugaacugugcuuauuuuaggcuaaauacuuguuagcauucacacuuugguuuuguuuucaaaucuauuuagacuuuucucuaaccauacuacaaaaaaauguuaaaggcaguuuuucaggcccaaggaaaaugauaccagauggaaauacggaucuauacaaaggaauuaaaagcucuagaaaugguaaccacacgaguaaauaugugccagucucacucugucacccaggcuggaaugcaguagugcaaccacaacucacugcagccucgaccuccaaggcucaagcaguccucucaccucagccuccugaguagcugggacaacaggcaugcaccaccacagcugucuaacuuuuuauuuuuuguagaggcgagagucuuacuauauugcccaaccugaucuuaaacuucugggcuuaagugauccuccugccuuggccucccagagugaugggauuucaggugggagcuaccaaugugaaguuuuaauauaugcaaaaguaaaauauaugcuaaaauagcacaaaggucuggggggagaaauggaaguauacuauuauauacuaugccugaggugacauaauauuacuugaagauagauugugaaaaguuaaagauguacacuauaaaccuaaagcaaccaauaagaaaacaaagaauuauagcuuauuagcuaacaaggaaaagagaauaaaaaauaauuaagaaaaauaaaugcagaaaaguaaacaggaacaaagaacagucaagaagaaaacaaauaugaagcugauagcuuuaaaccuaaucauaucacaaauuauauuaaauguaaauggucugaacacccaauuggaaagcagagauuaucagauuggauacaaccacaugcugccuacccccuaaagaugccacuuaaauaugaagaaacauacagauuaaacaaaaaagaaugggagaggauaugucaugauaacacuaaucaaaguaagacagaauuggcuauaguaauaucaaaguagauuucagagaauguuaccagugguaaagaagggcauuuccuaaugauaaaagggucaauuuaucaaaaggaucuaccaaauaacauaguuucaaaacacaacaggguaaaaacugcaaggagaaguaaauccacaguuauauucagggauuucaauaucccuuuuugaacaaugauagaaguaguagucagaaaaucaguaaggauauggaagauuugaacacuaucaaccaaauucacguaaugaccauuuauguaacacucuaccagcagcagcagugcuuuuuaagugcacacagaauauugauuucaagauuuauaaggcuaaagucaucacgacaguguggugguagcauauaaauaagcaaauugaucaguggaacaaauagaguaggagucauccuaccuucuguuuucauaaaguacuguuagaacacagccaccccuguuuguuuauguauuuucuaugguugcuuuugugucguaacaguagauugguagcuccaauagagaccuuauggcucacaaaccuagaauauuuaccuccuaccucauacaugaaaagcuugcccacccuggaauugagaguagccaaauagacccacaccugugaacaacugauuuuuaagaaagacgcaaaggcaauucacuugagaaaggauaauuuuuucagcaaauaguuuugaaacaauuauccguauauacaaaaugaacucaaauuucagcuugacaccacacauaaauauuaacuugaaauaacugagaccuaaaugacccuaaaacuauaaaacuuguaggaaaaaaccuuuuugacuuuauuuuuauuuuuuauauuuuuuuuuuuuugagaaggagucucauuuugucacccaggcuggagugcaguggugcuaucucugcucacuugcagccuccucugccucccggguucaagcaguucucuugccucagcuuccuguguagcugggauuacagaugugcaccaccacacccggcuaauuuuuaaaauauuuuaguagagacaggguuucaccauauacccaggcuggucucgaacuucugaacucaggugaucuacccacuucggccucccaaagugaugggauuacaagugugagcuacugcgucgggcccuuuaugauuuuagauuaagcaaagacuucuuagauacaucaaaaacacaaauugaugaauugaacuuuauuaaaauuaaaccuccuauucgucaaaagauacuguuaaaagaaugaaaagacaagcauacaagaaaauaaugcguaaauccauuuucuaauaaaggccagaauaucuucuuagaacuuucaaaacuuaaugagaaaacaggaaacccaguugaucaauauguuugaacagacacaucaucaaagaagauauagccaagcacacaccugccguagggccuagccauuccacucuucacuuaccuucuauuuuggggacacacacuauguguuaguuuccuaggggcuacuguaauagagcaucccuuuguuacaguaucccuuaccugaaauacuuaguaacagaaguauauuggauuuuggauuuuuuuuuuucaguuuguguuguauuugcauuauauacuuaaaguuaagcaucccaaauccuaaaaucugaaauccaaaaugccagagcucaaaacguuuuggaauuagagcauuucaguuuuuagauuugggauguucaaccuguaccacaaauuggguggcucaaaacaacaaauuuauucucucaagguuuuggaggcuagaaguccuuuugagacuuuggauagaaucuuccuuugccucuccuagcuucuggugguagccaucgucguugagauuccuuagcuuacagcugcauaacuccaaucucugccuguguauucacaugguauucuuccuggcucugucucuuuaaagacaccagucauauuguacuaaaggccuauuauacuccacuauaacauccaauuaaaucugcccauagaguaacauuuugugcuacugggguuaagacuucaacauauuuuuuggggggaacaguucagcccauaacaaacaaaaagaaaauuaauuuaauuauauuguauuuagaacagggguuggcaaacuauagcccauaagccaaauccagcuugcagccauuuuuauaaauaaaguugcaugggaauauaccuaugcccacuuauuuacauauuguguauggcugcuuuugcacuuuaauaacggaguuaacuaauugcaagagagaacuuaaagcccacgaaaucuaaaauauuuauuaucuggcccuuuacagaaaauguuugcuagccuauuuuagaagguguuaaguguuguagaaaaaaaaaaaaucaguaaagggguauaagaaacacagggugguuagggaagaucucuaugaggaggugaauuugagcaaaggcuacaaggaauuacucucuauauauuaacuuaugaagauguccacuauguaguguuaagugaaaaagguuauaaaacauuucucacuuacaugaucccaucuuuguaaaauagaaaaguguguauauuuauacaauguaaaguuauauaauacauguauaaaaaauuuugcaagaauauccaccaaaauguucaugguaguuaucucuuggugggauuauagugcacuuucacauggcauuuuuucaguuucuuuucauuagacauuuaaaaaauauuuuuauaaauuuaauuccuuauguguuauuaaguuauaucaaaggcuuaauguguaugaaacaauaauggaagauucaacuccuugccuaaguuugaaguuacuuguuguauuucaaagaggagcacuaguacuuaagcuagaauuuaagugaacaaaucuuaaaauggauuuuuaucucugguuacauagaauaguuguuagcaggcuuaauuuagugcuaguagaagaagaaauaugugauuguuaaagaacuccgucugucauaaauguuccugucauguuucugugacauuacauagacgucagggaaguuugcauuaggugugggugagccaauaauguuugcaagcguauaucaaaucauagcacuagggcugggcgcgguggcucaugccuguaaucccaacacuuugggagucugaggugggcagaucccuuugagcucagccugggcaacauggcaaaacacuaucuguacuaaaaauaaaaaaauuagcuaggcaugauggugccaucucuagucccagcuacucgggaggcugaggugggagaauuaccugagccugggaaguucaagcugcagugagcuguaauugugcuacugcacugcagccuggugaugggagugagacauugucucaaaaaaaaaaaaaaaaagcacuagaauauuugaauacucuuauacaaguguuuauggguuuauuuuauucugaagcucagaacauaucuaaaguaggauacuuucugcaaacccaaaagccuaagagcagauggggauuuuuaaaguacacauauaauaaaauuaucaaagccagccuucugaacaagacucuccucucuuuacagugaaacccaauggaaaaagcaugacauuuagaaguagaagacuuagcuucaaaucccuacuccuucacuuacuaauuuugugauuuggguaaguaauugaucuugucugaauuuuuuguuuuuuuauuuuacaaaguuccaauaaauaaucccugcccuacucaccugauucuuuaggauauuaggagacuaaagugaaauaauuuaugugacaacauuuuguguaauguaaaauaauauccuaguguuaauuguuaugaacucauaauugauacuaauggaagagaacagaguggauaauuuaaaaacuaauuuaauaauuaguuaauuuuguguagguauuaccaacuucuggcaguuuauucacaguaacacuguacugugaaagauauauagaaauuuucuucaucuugauccccacgcaacuuauuaauucaacaagcauuauuuugccuucuauuuggcaauuuuaguucauauacuguucuacaauuguaauaguaauguuaccauaguaacaaaguuuauauugacauucuuuuucacaugcaauguaaaucuaaauauauucgugcuuuuuauuucauccuuagguuaaguuagaaaaugaaaaaaaaaucacaauccauaggugacaaaaauaauuuauaaagagccuaaccauuaaauauuuauccauuguaacucuacugcuuuuucucucacuugagaaaacauauggaaaugaaaguaaaugagaaugaacaacuauagggauaaucuugaauuuauucuauuuuaaauaaaucauuuaugaacuuuguuucucuaacauuaaaaguagcaauacuuguuauacaucaucuagcuccuuucggcacacuaccauguuauaucaccauaguugaggaaugauuacagcuuuugguuuucagaaauaaucuuuccuguauuuaugguuacuaguuagguuuuggcuucauagaagcuucucaaguuaccugcaaauuucaaggaagguuaguguaugcaauguaugguuauaauauaugcauagaaaacucugcaagaggugagguaauagugcuauuaauauaauuuuaaauuaaauauuaguaucaacagaaggaaaggagggaaaaaauaagcaaacuacugucaauucugucaauuuuuuuuuuuauuuuuuugagauggagucucgcucugucacccaggcuggagugcaauggcacgaucuuggcucgcugcaaccuccgccucccagguucaagugauucuccuaccucagccuccugaguagcugggacuauaggugugcgccaccaugcccggcuaauuuuuguauuuuuauuagagacggggcuucaucauauugguuaggcucgucuugaacuccugaccuugucauccgccugccuuggcuucccaaagugcugggauuacaggcaugagccaccgcacccggccauaauucugucaauuuuuaagcaagccccaagugaaguuaacuguauugcauauaauauuuuauauaguguuacugugucuucaucucuuagauuuggacuaugaaaucaagucccauaauagauguuucuucaucaccucuccauuacaaucuuuuaaaaauuaggaaagauuacuuucuaaaugugaaauguggaaucuaccuuugccuaguucgcuuugcuuguguuccaugguacuacucaaacaaaucuaauugcuuugaaguaaucauaaauucuuucauggaccucuuguucuggagcagcuuuguugcaagaauauaguacauuuggcuuggcacaguggcucacaccuguaauuccagcacuuuggguggccaaagaaggaggauugcuucagaccaggaguuugggaccugccugugcaacauagugagacccccaucuuuacagaaaaauuuuuaaaaaauuagcugggcaugcuggcaagcuguuacaugauuagggagugcauaaaaucaaguuaguauguauauuuaauaaaacaauauuguguuccaagugcagaacuaggaagccauuucucaucaagaagaguuaauaguuuuauuuagaagaaaaaaauuacacauuaaguauuuugucuuuaauaauuuuagcuuuuauuuuagguucagggaguucauguacagguuacaugaguauauugugugaugcugagguuuggaguacgauugaacugucacccaguuggugagcauaguacccaauaguuugaaccuuaaguauuuauuuauuuuauuuauuuuuugagacggaguuucacucugucgcccagccuggagugcaguggcgccaucuccguucacugcaaccuccgccucccggguucaagugauucuccugccucagccucccaaguagcugggauuacaggugcccaccaccacgcccagcuacuuuuuguauuuuuaguauggacgggguuucaccauguaggccaggcuggucuggaacuccugaccucagaugauccacccaccucggccucccugagugcugggauuacaggcgugagccacugcaccuagcugacauuaaguauuuuuuaauuuaaauuuauuuuuugcauaaguacuaaagauucacauggucaacauugcaaggcugcagaguauaugguggagcgucucccuaccacccugaucucucaaauacccugucacagccaguauuugaacuuuuauccuccuagagauacugugcauauauaaaaaaacgaauguguguuuuguuuucuuguauauuguuuugcccacaaauaauagcaaaugcguuguucuguaccuuaacaauguaacaauguauuuuagauaacuuuauguuucuguacauauagagcuuccucauuuuuuuuaaauggcuacaaguauuuacauuuacaugguuuugguauaccaucauuuaacuagugucccaucauaaucagguuguuucagccuuuuacuguuaaaaacaaugcagugaauaacuuuguacauguguuguuuuauucauaucuguaggauaaaauaaaguagaaucauuagaaucaaauguguguguuuuaauuuugauugauauugccgaacuggcucucugccuuguuuggguagagcuuuuuucuuuguuuuuaagugaggucuaauuuacaaacaacaaaacugaccauuuuuaaaguguucaauguauugggaagcuuaugccaauuuacacuauaaccuguagugugugacgauacuuucguugcuuagucucacaacacccuguugauacuuuuuggguuuuuauauuuuugccaacacuaauauguaagaaugguauugggauaauuuuugguuuguuuaccuuuuguuacauacugcaaaacagaacucauaaguguacagcucagugaauuuaucacuguccagaucaagauacagaacaugcucagcacccagaauguccccuuuuauacccuuccucacaaaaaacaacugcucugaccucugucaccaaacaccguagacuuuugccucuuuuugaacuucuguaaaauaaaucaugcagagcguacuuucuugccuuuuuucucuuuuaaaauuuuuuuguagagucagggucucacuauuuugugcaggcuggccucuuaacuccuggccucaagcaauucuucccccucagccucccaaagugcugauaugacaggugugggccacugcacccaaccugucugauuucuuucauucuguauuauauaugagauucauccaugaugcauguaucuguuguuauuuuucauugcugugauucaauuacuugaauauaccauaauuuauccuaguguuaauagauauuugguugauuuuauuuuucaucuauuuugaauaaaacuucuguaaacauucuuguagaugucuuuggagguauuaagcacucguuucuuuugguuauaccuuaucugggcagauuuuguuuguuuuaaggucuaauuuauaaacaauaaaauucaccauuuuuuaguuacaacuugauaggaaacccaugagucuaacauuucugcguuucuuaucagcaaaaacccugauggcugccuuuuuucugaacuuuguuuugagacggagucucgcucugucaccuaggcuggagugcaguggugugaccucggcucacugcagccuccgccucccagguucaagcaguucucugccucagccuccugaguagcugggauuacaggcggccgccaccacgccuggcuaauuuuuguauuuuuauuagggacaggguuucaccauguuggucaggcuggucuugaacuccugaccucaugauucacucgccucagccucccaaagugcugggauuauaggcgugagccaccaugcccagccaacuuaccuuuuaaagaauguuggaagguagacucucagagccguggagcaaaggacaggcuuacuuacagucuucaaagauacagauaaugucucccucuagaguaaauggcagacaugcuuccugcauauuuuucaaguuuaggguuacuuaagaucugucuuucuuuccugugaagcagccuguucaggugucaucugacuucacaaugcccugugacaguugggacucaagcagcuggcgcaagaaaaugcugauacucugacuacuguuaugaguaauacaguccuuugcuucugacgcaaaaaugucaugccuuuugccaguauccaugacacugugguaggcugacuuguuagcuugaaaguaagguaaaaucucagugccuuugaaacaguugacacagaauucagugaauuuugacaaauguagucuuuuuuuuuuuuuaaauagaauuucgcuuuguugcccaggcuggagugcaguggugccaucucagcucacugcagccccugccuuccggguucaaacagcucuccugccucaagccucaugaguagcugggacugcaggcauacaccaccacaccuggcgugugugugugugugugugucugugugugucggggucucgcucuguugcccaugcuggaguccaguggcaugaucugggcuuacugcaaccucuguuucacggguucaaacaguucuccugccucagccucccgaguagcuggcaucacagacacccgccaccacgccaagcuacuuuuuguauuuuuaauagagaugggguuucaccauguuggccaggcucgucucgaacuccugaccucaagugaucugcccaccucggccucccaaagugcugggauuacaggcgugagccaucgcguccugccaaauguauagagucuuauagucaccaccacaaucaagucauagaguauuuuuaucaccccagauuuccuuuaugcccuuuuacgugugccuucucuaccucagcccuaggcaacccuggaucugcuuucugucaccuuaguuuugccguaucaagaauuucugaggcacaugccuguaaucccagugcuuugggaggcugaggcaggaggauugcucgagcccaggaguuugagacagccugggcaacauagugagacccccaucucuuaaaaaaaaaaagaauuuccuguaaauagaguuauacaauguauaaccuguugugucuggcuucguuuauucaguguaaugcuuuugagauucauucauacuacugcauguaucaccaguucauacucuuuuuuuuuuguuugcugaguaguauucuauuauaugucucuaccauuguuugaauguauguuuauacauucagcaguugguggacauuuggauuguuuccaguuugggacuuaugaaugaagcugcugugaacauuugaguauaagucuuauugugggcauauguuuuuauuuuggggaguacgcucuuuggaguggaaauaccaagucuuauggugugcuuuuaacuugguaacgaacuaucaaauuguuuaccagagugucuguaucauuuugcguuccuaucugaguaguucuaauuuauaucucucauuuugagugagguugaaaguaucuuuucacaugcuugauuuacuuguauuuccuuuucuauaaacuauucaaauauguuugccuguucuauuagguguuagaauuuuuuagugauuuguaggcauucuuuauauaucgggaaaauuuuuggccaugcuaugaauuacaaacauuuuuuuccauuugucagguaucuuuuaaggauacauauuauggugaguuuugccauguagaaauuugucagucugaaguucuuaaucucacaguuauuuacuaauauaagacuucacauaagaaagaaacaagauaucucuuuuaauuaaccuuaaaguauaaauuauguuuucuagcaguguuuuccauagccauaacuucagugggaauaaagaaaaauaaugugaagacuuaaguuuucuacauucucauaagaauuuuaccaccuuuuagaaacacagcuacagcauggaaacaagauugugucuuaaauuauguguauauaagagaaaaaauauuaaaaguaauauuacaugugucuguugcagaaauauccgcgcaagauguugacguugcagacuuggcuagugcaagccuuguuuauuuuccucaccacugaaucuacagguaagguucaugaaauacccuaucuucuaacuucacaaauuagguuuauauauuuuuauauuauuauauaauuaagcuuauguuuaauuauuauguucauauauucuuucuaggauaaucgagagaauaauaucuuaaauugauuuuaauaaaaauauucuugauaaucuguuuuuguauaauuugaguuguaacagucaucuuacaugcuaagucaguaauuuaagucaguaaucuuaaaugcuguauaucaauacuaacaauaacuuuaaaauggggaaggaaagaaguguguggguuuuuuuuuuuuucuucaguaaaugaauaggagaaaauuuguuaaaucuuguuaaauuuuacgucauucauacuacaugcucuucagguauugaagggcugcuuuccugugucuguaaguccuuguccccaaauuacaguuacccagauaucuaaucauucuauaggaucugguuuuuaacccugugcaugcugauuacccuacugauucuucucuuaguugccuguauuacauuuaaaauagaauacuggcuggacaugguggcucacaccuguaaucccagaaccuugggaggcauaggcaggaaaauaacuugaguccaggaauucagucugggcaacaaagcaaggccccaucucuacaauuuuuuuuuuuaauuagccaaguauuaguccauucucacacugcuauaaagaaauaccugagacuggguaauuuauaaagaaaagguuuaauugauucacaguucuguaggcugugcggaagcaugguggcaucugcuucuggggaggcuuugggaaguuuccagucauggcagaagacaaagggggagugaggcaucucacauagcgagaacaggaggaagagagagagaaagggaaggugcuacaaacuuuuaaaugaccagagcucacaauaacucauuccucauccaccaucucgaggcaguaccaagugagaaauccaccccuaugauuuaaucaccucuccaccaggccccaccuccaacacuggggauuaugauacgacaugagauuuggguggggacacagauucaaaccauaucaugccucuagucccaacuacucaggaggcugagccaggagaaucaugagcccuggaccucgaggucacagugagccauggucacgccauugcacucuauccuggguaacagagcaagacccugucucguaaaaauauuuauguguacguguguguguguguguguguguguguauguguguguguguguguguaugaauaauacuaucccagcugucccccuuacuagcuguaggaccuuggucagucauuuucuguaccucaauuuccugaucuaugaaauggugauaauaaaggccacuaccuccuaggguuauuagugaggauuaaagaaguuaauauagaggccaggcaugguggcucaugccaguaauccaagcacuuugggaggccgagauggguggaucauuugagguuaggaguucaagacuagccuggccaacaugguaaaaccccguaucuacuaaaaauacaaaaauuagccaggcgguagugccgcacgccuguaauccccacuacucaggaggcugaggcaggagaaucgcuugagccugggaggcggagguugcagugagccaagauugcaccacugcacuccagucugggugacagagugaaacccuguuuccaaaaaaaaaaaucugagcuugguagcacaugccugaaagucucagcuacuugggaggcugaggugggagagucacuugaacccgggaggcaaagguugcgguguguggagauugugccacugcacuccagccuaggguggcagacugagacccuaucucaaaaaacaaccaaaaauaaguuaauauagaggaaauauuuggacaguguuuggccuacaguaagcauuauaaaaaugauaguuacugcauauuuauuauaaagguuauuguugucuuugaauaaaaguuucuuuaugaaaaaaauaaacguaauauaccaaaaccaaucugacuacaguggcacucauacuuacuuugaucugaacaucauuuuuauaaaguuacguaacuaugugguagcugagauauacccuuguuucauguugagcuagugaucagugaaaauucucaggugguuuuuacaugaguuacucuuaaacuaguucucccucacccaauguauauuucuuauuaccuaaauaggauauauuuccucuguugcuaauuucauuuuaucaguuuuagccugguguucuacucuuucagcauaauuuuaaaucccaacauuuucauccgaaguguuggcaguuguuuguaguccuguccucugcuaauuugauaagcaugugugucugucuuuucccaaguuguugauuaaaauguugaaaauaacaggacugcauuagcuaccuguugcugccucacaaauacuccaaaucuucaaggcuuaaaaugauaauaauaccucucaugauuuguauaggacaagacuauagauaggcaggcacaaucagacguauucaucuuugcuguacaaugucuggggccucagcugcaauauucagacugggggcuggagucaucuucagacuccuucgcuuauaugucuguuguuaaugguaucugcaggcugagggcuuugcuggggccauuguccaaaacaccauacguggccucuuuuuauggcccuggcuuucuuacaauguguggcuggguucuaagggcagauaucccgggagagagaaagaaagcuaauuggagucuguauucuuuuaaugaucuagccucugaagucucauagcacacuccauuggcuggaguggacacaaggcacccauacagaucugaugugguugggggaaaugcaguccccaccucuucaugaaaagaguaugcgugacaucguaagaaaaacgugggaugggauaaauauguagguguggccauucuuaaaauacagucuucuccaaggauugagggcaugcacuucagcauauucuacuuaagacuauccucuaauugacuuuuuucuuaagucaguuuuuuuauauauggguaaucaaauauaaauuugaguaugaaccuauaaaaguagcaaaauaucagcaauuucauaauguucauuguaauaucgguuauaguauauucuuuuuuuuuuugcuuuuuuucuuuuuuuuugagauggaaucucguuucguugccuaggcuggagugcaguggcacaaucucagcucacugcaaccucugccccccagguucaagcaauucuccugccucagccuccugaguagcuggaauuacaggugcaggucaccacgcccggguaauuuuuguauuuuuaguagagacgggauuucaccauguuggucaggcuggucuagaacuccucaucucaggugauccauccaccucggccucccaaagugcugggauuacagacgugagucacugcguccaacccaguuauaguguauucuaauucacauuucuucaucuugcccuauaaacauucaaaauaacuuuaucagauaccuuucuuaauuaaaauacuuucuuuuuacaauuuaaucucagccugguagcccuguaaaaugggauuaauuugacaugggaugguauuauugaagcugugucucacuuugaaaaacggaacauuugccccuuuuuuuucgagacugaaucucacucugucgcucaggcuggagugcaguggugugaucuuggcucacugcaagcuccgccuccuggguucacaccauucuccugccucagccucccaaguagcugggacuacaggcgcccgccaccacgcccggcuaauuuuuuguauuuuuaguagagacaggguuucacuauguuagccacgauggccuugaucuccugaccucgugauccacccaccucggccucccaaagugcugggauuacaggugugagccacugcgcccagcccauuugcccauuuuuaauauuucucuuauucugugugauuaaaaauuauucauacugagucucuaauuauaucuuuuuagaacucuagaguauauuucauauuuaacaucccuaugauuacuuuagagaaaguauaacaagugauuuugccaaagaauaaagugaugucuagggaauuguaaggucugacccaguaucagagaguaacuuaguagagauucuccacuggaugaaggaccaugcuauuggaaauugagaguaauauaugcacuaagauuuacaguaggcauuuauaaauaacagcaagaugauauaaacagaccacauuauaaguuugaaacaaagaaauacacauuccagcucuggguuuuacaggcuuugugagagguccugggauuccauuuggggauacaauuuugacugcaaaaacuguuuuuaauuuuuucugggcucacugcagccuugaccucuugggcucaagcaauccuccugccucagcacacgacccucacccccaaguagcugggacuacaggcgugugccaccaugccuggcuaauauuuauauuuuuuuuguagagaugggguuuugccauguugcccaggcuaguaauuuuuaaucucaaaaacacuucauggguaacuacccaggaaccccacagcaaauaggauucauugaggaaagccaccuuaaaauuguggacauugaagcuagagaaaaagaauaaaaucaugucaaauaguugggacuuuuaucuugguaguagguagccacuaaauaauuuaaaguagacaaauguccuaauuauuuuagaacaguaacugacaguaguauguaagauaaacuggaaggaggucagacugauauaguauccugugcuucagcagucaaaguagcauuggaaagaagauguugauaugcuuauuaagcauauagaaccaauacagugcacuauuguuaaguuggagguuagaggaggcuaauuggagauguuggaagaugacuacagaguaucuguccuggaugucuggaugggaguggugcuguuagcagaggcagagaaauaagaauaaaaaauaauaaguuugaaaagauuaugauacauaauaguuuuggacaugcucauuuaaaaauagcuaugggauaucucagguagauauaugucuaaugggcuauugaaagcauggggguuuagugcuagagauagggauugagaugucaucaauguggaguaggugauagguaaagcauguaguuguguuuaauucucuuuuacccaaucugauucuuuguguuuuguuuuguuuguuuuguuuuguuuuguuuuuugagacucugucucacucugucucccaagcuggagugcaguggcgugaucucacugcaaccuccacuuccuggguucaggugauucucaugccucagccucccaagcagcugggauuacaggugcccaccaugacacccagcuaauuuuuguauuuuuaguagagacuggguuuuagcauguugguuaggcugauucuuuguuuuuaaauaggggauccuaucccaugcauuuauuuucacucuguuguccaggguggagugcaguggcuuacuacauccuugaccccuugggcucaagccaucaucccacuucagccucccgaauagcugggacuauaggcgugcaccaccaugcucggcuaauuuuuuuuguuuuuaguacagauggcaucucccuauguugcccaagcugguuucaaacuccugagcucgagcgauccucuugccucggccucccaaaagugcugagauuauagacgcaaaccaucauacccagggccaugcauuuauucuuaaaacuaaacuauuuggccaucuuguucuauucuuccuguuuuguauuggucccuugcuguuuccuuuguugucugaguuuugauguguggacaauguauacugucugugaccccaacuguacuccacaacagcauucaggacuguagaggagaccaccacugccuguuuucuggagaguuuaguuuagaccugggaucuaaauggagggacaggauacguuguggggcaaguaugaaucaugcugcaggcagucuguguuucuuaaagaaauaguuuauaccaugggcuauaaagcaugaauggguuuuucuuaauucagcucuauuaucuuuauaauuuguauauuucuuuacaaauucaggcauuaaauucuaaccauauuaauuuucaguuguguauugucuuuuucugugucuuuagggauauuuuagugacgguugagggacucuacauugagugcuaccagcuagauaucauuuuguaccagaaaaauucaguccauuuauauauuuucuauuguuccuuuuuaggugaacuucuagauccaugugguuauaucaguccugaaucuccaguuguacaacuucauucuaauuucacugcaguuugugugcuaaaggaaaaauguauggauuauuuucauguaaaugcuaauuacauugucuggaaaacaaaccauuuuacuauuccuaaggagcaauauacuaucauaaacagaacagcauccagugucaccuuuacagauauagcuucauuaaauauucagcucacuugcaacauucuuacauucggacagcuugaacagaauguuuauggaaucacaauaauuucaggcuguaaguuuuguuuuugucuuauuucagacuuugucaugacuauugaacugcauuuuuaauguuguccuuucaucuuuauaaaauguaguaacuuguggacuuagugacuuggacauguuugguuuuuaaaaaauaagcuuagaaguaggaaccacaagucuccugucuuuccugaaagucaagcaguuucacuuuacuagagaaauauuugacaugagaccccccccaccacaggaaaguauuguugaauugacauaaugaugguaauucucaguaucccuuaauugcugagaaaaugcacguguaaagcagcuaccugaagaaagcgaacaaauacuggaguaaauccuuuuuuuuuuuuuggugacagagucucgcucugucacccaggcuggagugcaguggcaucaucucagcucacugcccucccggguucaagcaauccuccugccucagccucccaaguagcugggacuacaggcaugagccaccacgcccggcuaauuuuucauauuuuuaguagaaaugggguuucgccauguuggccaggcuggucucaaacuccugaccucaggugauccacuugccucgggcucccaaacugcugggauuacaggcgugagccacugugccuggccuuggaguaacaaaguaaacaaaauaaacuuacuaugauccaaaaguggguuaucuaauuuguggaucacccagacuuuacuguuuuggcauuugcuuuucuuccaacgaguuugggaaagcaauaagaagagaaauauaaaugaaucauuuuggcuucuacuuaguugccucuuacaaacauauguauauauuacuuuuaaaaauauacuuaauggagaaaucaguugauauuuuuuuccaguuauaaaugaaaguugauuuuacauagaaaauuaaugugaaacaaaccaguugaugacaguuaggauggauguauauauauuacuuccugaaaagaaguguaagaguugggauagaaaagaaauugucaucagccuuucauuguguccauacuuuuugcuuggguuugauuuuuuucaucuaauuuagaucgcaaaugccuuggguaguauauaaauugcauaauauuuguggauauaaagcuuucugaaagaugcuaauuaaucccuuuuagugccuccagaaaaaccuaaaaauuugaguugcauugugaacgaggggaagaaaaugaggugugagugggaugguggaagggaaacacacuuggagacaaacuucacuuuaaaaucugaaugguacguuauuuuaaauuuguuucauguuagauuuauuaaaguuagucauuuuugcuggaauuuuuauuuuaccaaguaauaauauuaaaugcuauuuuaaaacauuuaauuuuuuauucuguaacauuucaaauauauguaaaaguagaggccaggcgcgguggcucaugccuguaaucccccaggcgcggcggcccaugccuguaacuccagcacuuacggaggcugaggugggcagauaacuugaggucaggaguucgagaccagccuggccaaccagagcaaaacccugucucuaccaaaacuacaaaaauuagccaggcaugguggcgggugccuguaaucccagugacucggagguugaggcaggagaaucacuuaaauccaggaggcggagguugcagugagcccggauugcaccacuacacuccagccuggguaacagagugagacuccaucucaaaaaaaauaaauaaauaaaaaauaaaaguagaaagaauaguagaauacccauacauacccaucacucagcuucaacacuggucagcucaugaccagucuuauuucaaagguacucuuugccuauauugucuugaagagagaaucgcgggcaucauauuucauccaaagauauuucaguaugcgucucuaaaagaugaggacauuuuaaaaaaaagcauaacaacauaccacuguuacacucagauauaaaauauuacauuuucaguuaguguugauuuccccuaugucucaugaauaugccuauauguauaauuuuuuuuacauuuguuucagucaagauucgaauaagcuccauacuuugugaauuuaugucuugucucuuaaauuauagguucuauuuguucuuuuuucuuacauuucaguuguuaaacuguuauacauuguacauuguuuaacauauucccuugucuuuuuuuuuuuuuuuuuuuuuuuuuuuuuuuuuuugagauggagucuugcucugucaccuaggcuggaguacaguggcaugaucucugcucacugcaaccuccgcuucccagguucaagcaauucuccugccucagccuccugaguagcugggauuacaggcaugugccaccaugcccagcuaauuuuuuucuauuuuuaauagagaggguuucaccauguuggucaggcuggucuugaacuccugaccucgugaucuggcugccucugccucccagagugcuuagaugauagacguggccaccgcgccuggcccccuugucuuuuucuuuccaaaaaauugcuuuuagaucuacagauuucaucagauuuggguuugauuuuuuuuuuuuccccaaaaaaauauuuuguaggagugauguguacuucugucaggaaagaccagauaauguuucacuguuuuucuuuuuucugauacuaagauugagcagugguuucggguguugucagccuuauuccuuuauuuacuaaguuucccauuuguuuuuuccaaacagaaaaguugaaagaguuuuacagugaacacucuugcauacccuagauucuacaauuaacauuuuacuaucuuugcuuuaucaccuauuuaucuaugcauccuucucuccaucucucaaucuaucucuuuuuuauguauuucauagugaguugcagucauuaauauaccucacccuuaaucacuucaguauuucauagugaguuacagucauuaauauaccucauucuuaaucacuucaguauuuacaugaacuagaguucaguauuauguuuuuaaauaaaauuuacauauagugaaaacacaaaucuuaguguaucauucagugaguuuugacaaguacagacaccuguguaacucaaucaguaucaagacauagaacaugacuaacacaccuaaaaaguuccuuccugcuccuucagucaaucccagcaagugccccaccccaugagcaacuaccugucugauauucuucaccauagauuauuuuuuccuguuacagaaugucucauauaaaugggauuauauaguauauacucuucugugaaaaguuuuauaacucaacagaauguuuccgaaauuuaaucauguuguuuucccacuaguauuucccuuacagcuuugagcagucaucagugauuauaauuuguauauaaauuacaaaacuaugguauucuguguuuuguuuuagcugaaauacuuaaagaaaaacuugccuuuaucaacugugguuuacccugaaguacaguucagauaggagaagcaagauagguuuaauauuuuuccuuaauuaccaguuuuauaauuaguugauucccuaguauccuccaaagguagaauaaugagggcuuuucuuucucauuauaaauuuauauuuaaacauauuugauauguuuuaacucauuauggauugucccaucuuugaucaguggcaguuuacucaaauuggcucauucauccuuuuuuuuuuuuuuuuuugagacagaguuuugcucuuuugaccaggcuguagugaaguggcgugaucucggcucacugccucccgaguggcugggauuauaggcacccaccaccccgcccggcucauucaucgucuugacacaacuuccuuagccuuugauagcucucugauauaacaugcuuuuacagggucaucauguauuuccucacccagaccuggaaucaaccuuuucccaaaacucucugguuucauuuagugugaaauaauauuuacagacuacaaucugggugcuacaggaauucaucacuacugguuugucauaguuuuuagauuuuuuagauuuuuucagucgaaagagcuaggacauguuuugugguuugagauauaauacuaucuuuuaaaaauacaaauucauacugauauuuucaguuuaaaauuagggcuauagguuuuuacauaauuauauuuaccugacgucuacaucuucuuucuuaugaacugaaaaacauaguugacaacaacacuaacauaauuauucauuugcuuuauccuacgguuaauacagcagcugcagaauaauaacaacaguauuagcaccaacaaaaugauuaccaagaaugauuuuaagauuguuuuucucugugaaggauguguaauagucagauuacuguguuuuaauguuacuuggaauaguucuuuucuaugugguuauacuacauacucaguacacaaguucauauguuucauuuugcuuuuaauuuuuaggaauuuuucuuaauaauuauauaaaacaauccaaaaagucaaaucuauuaauaguauuaaggcuuguucagaaaagucuauauucuauuccugaauccucuaccuuauuuccuucuccuuagaggcuaaccauuuuuguuuugguucaauuugggguuugguuuauccuauuuuuaaaaacaguguuguauaugaauauuuuuaauugaggcauaauuuauauaauuguaaauaaauauaguaauauuacuugaaacuuuccauggugauagaaaucagaaaguaguugccuaaguuugacuagaaagaggcuaagagauuuuagcccuaagacuaaaggcuaagggguaauagaaauucuuaccccuaaccuccugucaccuucuagcauauugugcuuaaagaaauuugugguacaguaaggguucuguuuuaggaaaaagaaaaaacagcacugggaucacaaggaaauagauaauuuuuggagaggaguaaguggggauggagcauaaaauuuuaaagcacaauauuuuuagacuacaaauuugaaaauaauuuuauguuuuaagauauagaucaaaguuaauuuuaaagaaagguuuauuuuuaagaaauuuuguuagugaccagcaguuauauugcaaaguuugcuacaacaaucuaggucucaucaaacucuuugcaaguaauuuuuuucacucuaauuuuuucagauguguuuuuaaugacugauucuucaauuuuuuguauuuagggcaacacacaaguuugcugauugcaaagcaaaacgugacacccccaccucaugcacuguugauuauucuacuguguauuuugucaacauugaagucuggguagaagcagagaaugcccuugggaagguuacaucagaucauaucaauuuugauccuguauauaaagguaguuauaaaccugaauuugagaguuuauuugacacuguagucguuuacaaauuaaaguaguuuuuauauuuagauuuuuuaagauuuuaauguagauuuuuagauuuuaauuaauguaguuuuuagauuuuacuuuuuuagauuuuaauuaauguagauuuuagauuuuaauuaauguagaaacaagcauuuaucuuagugauuuuuaugaagucauuuuaucaauaauaucaaauagaauuuggaaaaagaaaaauauccauaauccaaccacacuuaacagcuguuuucacuuugaauguuuucuguucucaaacaucuuacaccauuguaauuacaguauguauguuccauuuuuauucuuuuuuaaaaauuugauaucauaaauauuugucuuuugacauaugaaccugaagagauuaacaaauguaaauuaacaaggagaacugaagauucuuuagaaaucuuuuuuuuuccauuauaagguauauagcauagcauaauuuucagagaaauuaguucauuugguaaggauaaauuauuguaaaauaaaggaaggacaauauaaagaguauauuugaguuuguauaugaaauuggaaaacauaauaaaccuuaggauuuauuuuauuuuucagugaagcccaauccgccacauaauuuaucagugaucaacucagaggaacugucuaguaucuuaaaauugacauggaccaacccaaguauuaagaguguuauaauacuaaaauauaacauucaauauaggaccaaagaugccucaacuuggagccagguaaauugaaaguuaccguuuauucaaauaguccuucuuucaacccucuaaucuuaaaaaguuucagucauuuucuaaaugucuuuaaguuucugguuaugugaaauauuuugcuugauaaccucuucuggguuguuauuucaaacaaggggaaucaggaagauauccagauagaaaauacagcuuugcuaaauacaguagccuuuaaguaaaacaugaaaaugauauagggugauaggaaauggcuuuuuuuuuuuuuucuucuagagacagggucuccauuugcccaggccgcuggcucacugcaauuuugaacucgagcuuaagugauccuccugccuuagucucacuacaggugugcaccaccacaccuggcuuuuuaaaauuauuauuauuuuuuguggagauggagucucgccguguugcccaggauggucucaaacuccuggccuuaagcgauucuccuaccuuggccucccaaaaugcugggauuacagaugugagcuaccacuaccagccuagaaauggcauuuuugauggguguuacaaagaauacaaguaauaaagcaaauuaaguagaggagcaaaaauaaagagauuauaaggauaagguagcuaguguagggauuggugugcugcaguccaccaaaaucagccugugacuuguuuuuguaaauaaaguuuuacuggaacacagccacacucauuucuuuacauauugucucuauucuacaguggaagaguugaguaguugcaaaaagagucucuggcccacaagccuaaaauauuaguaaauauuuuaucuaccuuuuuauagaaaguuugccaaccacugagguagaggaagggauugauagggagcuuguaagacugaaaaugauaguauacccaaagaugaugcuaccagcaaaagaaauacuuggagcuuuuaaaaaggcuaucaccauagcauucagcuauccauacucuucucuguuuugauuccauuuaucacaaacaguaugucuuugcuuuuguugcucuggucacagugagcuuguuagggaauugggcuaaugacuuuacuacuucucuccuuaccccacuuaucuaaagugcucagaauacaaucagaaaaagcaauaaaacaaaauuggauuaaugcuucauguuguacagagaauauacauaccugaaguucuucaaaaugugguauuaaguauagaaucuuaauucagugcuacaaaaaagacugauguuuauuuuguaucuaauacuaaauuaucagaguaauaugaccaguuauuuaucuguauuuaaucuccucuuuuuuucugaaagccaaguuuaaaagccaggaaaacuuuuguuuuucuugauugggcuggauaucuuccuuuugccuguccacaucuacgcucuacccuucucuuuguugugucaugcugaccuguauagauuucaucuguggguuuccauucuuucuagcuuccuugugacugugguuaauggaaggaagggacuaggcaggagagaagacagaagaaaagugaaauuggcauguugauuuucccugcuuccuuccaggaacuggcugucuuuuuuuuuuuuuuugagauggaguuuagcucuuguugcccaggcuggaguguaauggcaugaucuuggcuuacugcaacuuccaccucccuaguucaagcgauucuucugccucagacucccgaguagcugggauuacaggugugugccaccaugcccagcuaauuuuuguguuuuuaguagagaugggguuucaccauguuggccagguuggucucgaacuccagaccucaggugauccaccuacuucagucucccaaagugcugggauuacaagcgugagccaccgcacccagccggcugucuuucaacuuagggucacuaccugucaagacagcccucucuagcugaccggcuucuuucagguucugguacuuccccucaucccuuugggccuagagguagaaacagcucuaagccccagaguacuaacugcacugucuaaggauuccauauacucugcauguagucccuuuaugaagcccuccuugaauuauucuaaauggagugugccaucuguuuccugcagaaauccuaaguuauauuacaggcccuguggaagaaauaaagggaaaaaaggaaagauaauagauguuuccauacuucuaaaaccaaauaacuuuacugauuuggacugcuuuuuaacuuacacuuauuucucuccagagguugaguuuaauguauuagucuugugucaauaaaauaguuucaagaggcugaggcaauagaaucacuugaaccugggaggcggagguugcagugagcugagaucgcgccauugcaccauugagcuccagccugggcgacagagggagacucugucucaaaaauaaauaguuucuaggcugagcgcaguggcucacaucuguaauccuggcacuuugggaggccgaggcaaguggauugcuugaggucaggaguuacagaccagcccggccaacauggugaaucuuguugauacuaaaaaaguacagaaauuagcugagagugguggcgggcaccuguaaucccagccacucaggaggcugaggcaggagaaucgcuugaaccugggagagguagagguuguguugagccaagaucgcaccacugcacuccaaccugggcaacagagcaaggcugugccucaaaaaaaaaaguuucugaauuuuaacacaauuuagaagaccuuacuaauugagguuuucuguuguuugguuugcuuuguuucagauuccuccugaagacacagcauccacccgaucuucauucacuguccaagaccuuaaaccuuuuacagaauauguguuuaggauucgcuguaugaaggaagaugguaagggauacuggagugacuggagugaagaagcaagugggaucaccuaugaagauaguaaguacauaaguauaugaagaaguaaagcuauuggaauuccagaugugaacugguucugguuuuaauaauauagccucauugcuucuuaguuugugaucauuuuauucaaacugcaguauuuuaacguuuuaauuuuuaaggacauuaagauguaaaauugaauauggaucauugauaguauaagucuauuugauaccuaauuaaauuaucauggaggccagaugcgguggcucacaccuguaaucccaguacuuugggaggccgaggugggcggaucacaaggucaggaguuugagaccagccuggccaauauggugaaaccccuucucuauuaaaaauacaaaaauuagccgggcgugguggugggcgccuguagucccagcuacucgggaggcugaggcaggagaaucgcuugaacccaggagguggagguugcagugagccaaggucacgccacugcacuucagccugggugacagaacgagacuccgucucaaaaaaaaaaaaaauucaucauggaauggugacuuagauacaucuaucagaaaaccguuaacuguugauaagucuagaacauuuuauucaaggagacuuguccagagauacuccuaacuagagaaucauauccugaaucauuaaaaccacacugucuagcaaacuacaccuuagauccccacuaucaaaaauauacuuguauuauaccuuuuauucauuuuuuuucuaauagcacuugauaagccccugggaagcgguugauccuggaauuuugguugguuaguuuuuauuuuccuuuuuucuccuauagauaauauauaugauauagaauaaaaaaggcacaaaaagaguguacagucuaaaguaagauccucacugcaaagcaucugauguuacuaaguucaagaaauaaucccguggcauagauuuuucauuuugagaccuuccuaucacagacucaucucuuaguuaucaauggcaguagcuguggcugaaaaaauccccuaccaccuauaucccuuuacuuccagcucuucuagagguuuaggucaugugacuugagaacaucaaaggcagaaaaguacccuucugcccuaagauuucucucauaaaugcugagaaagaaaucaauuuugcuauugcugcugugggaguccucagccagauugcuuugucuugaccaggaauucuuaaaaugagauacauggggaggaguucaugaaauaguuuaaaauguagguaaaauauugugguuagugccugugugcauuuuuaauggacaaguguacauaaucuuugucaaaucaaugcgugaaugaagucucuggguucccuuuauguuaggaaauauuuccagcucauaauuuuuuuuuaauaauuucauguucuuuauucuguuugagugcugcacuguacucaugugaauuuaucuauuuuaacuucuguaccagcagccuuuuucccagccuuccuggucugccuguccuauccuuucuguuuugcugucuguaauugccucuucaugauuaacauaucaguacuuaaauuuuuuuuuuuuuuuuuuuggaaauagugccucacucuauugcccaggcuggagugcaguggcaugaacacggcucgcugcagccucuaccuccaaggcugaagcgauccucaugccucagcccccaacauagcugggacuauaggcacgugucaccaugcccagcaaauuuuuguauuuuuuuguggagacaagguuuugucauggugcccaggcuggucuugaacuacugaacugaagugaaccacaucccucggccucccaaagugcugggaucgcaggcacgagccaccacacccagccuuacugcuuagauuuuauucaacuccugucuuauucuacugacuaccauaucuuguuauuauauucauaaaaauuuugagaaaucaguuaaugccauugauuuuuuuaagacaaacuuuuuacaaaaagcuuaacaaugauaaguaaaaaugaaaugucaguugauauuacuuauugcuaaaaaauuaaaaauuauaugcuacauuuaauggcuauuauaaguuuugaaaaauuaauacuacagguauuuuuaaaaccgaauuuaauuacugguauuuaacaauuuauguuuuggcuggguaugguggccaaaccccagcuacuuggguugcugaggugggaggaucaccugagccuaggagcugaagguuauagugcacuauagucauccacugcacuccagccugggcaacagagcgagacacugucucuggaaaaaaaccacuauguuuuauggauugcuuuuucagaugguuagugauuaucacaacaauacugugaauuuguuuuuauuacaucccaucacucucaaucauccuuauauaaaguaauaaacuuauuuuaguacauuuaucuuaauuuguuuuauuauucuugugaauauuuaggaguaagcaauguguuuaaauagauuuuccaguuugauuuucagcgauaaguaguaucaacuuauguuuauuucauuuuuauuuuuuacuguuaaaaacuuuauuuuaaaaaguuuuuuucuuuaaaaaaucauauuaacuaauuuuucaaaauuuuuauaaauauaauuagaagaccugguauuuaauagaauaagagaggaguugaauaaaaucuaagcagugauguguugaucaugaagaggcaauuacagaugacaaaacagaagugaggacaggcagaccaggaaggcugggaaaaggcugcugguacaggagauucaaguagauaaauacagugccagcacacaaacagaauaaagaacaugaaguuauaagaaagagugaugccucuuuaguuguugcucagaauacauuuuuaccuuuacaauuuugagguuagaaaagaguuccaguauaauugaucaggcuaucacccugacuaaaggaagagccagguguuuugugcuggguugggaaaaugcugguauaaagagguagagacaccaugcaauuggagggcaagaguauuaagaacaaaguaaaagaauaauuugcagaauuuuauuuuacuguuaaaaccuuuuuauuuuaaggaguuuaugucuuuucuuuaggaccaucuaaagcaccaaguuucugguauaaaauagauccaucccauacucaaggcuacagaacuguacaacucguguggaagguaaaaaaucacauuuauauuuuaucucuuauaaaucuuuuuuuuuuuuuuugaaaccgagucucgcuccauugccaggcaggaguguaguggcgugaucuuggcucacugcaaccucugccucccagguucaagugauucuccugccucagccuccugaguagcugggacuacaggugugcgccaccacgccccgcuaauuuuuguauuuuuagcagagacaggguuucaccacgguggccaggaugaucuugaucucuugaccucauguucugccugccucggccucccaaaguacugggauuacaggcaugagccaccgcgcccagcccuuauaaauacauuuuguaugguauuaugaauggaggucuuuuaaauagauaaauuuuuauucauuuuaauagcaaagcauuugauuacuauuuuuacuaaauagaaagguaaugcuuuauauguauuaauauuauauagaagucagguucauaaacuacaaauaauaccuuauagguauuuaaguacaguucugugaaaguauaaguucuauaagaagaggaauguuguuuuuguacuuuggaauuuuccagaguaacucagaaaauaauaaaaguuugugauaaucaaaauguaugcugguaagugcaugaguagaucauacuaaaaaagaagguagaaaaauacucaagcauaaaauaaauaauuuagaccuacauagccacagugcagaauugauacagaaccaaaagcuaacggaaugaugcuacuuacccuuuuuuaguugaggucaugcuuuuacucuucauuuaguauguacuaguuuuauuuuagaaccaaauuuaaaauggagauugugaauccuuuccaguuaaauauuuagagauuugacauaauggcaugauuugugaauaugaagaaaaacugauuuuuuauucaagauuuaugagauuauuuuuaaaaauaaacuauuuuauuacagacauugccuccuuuugaagccaauggaaaaaucuuggauuaugaagugacucucacaagauggaaaucacauuuacaaaauuacacaguuaaugccacaaaacugacaguaaaucucacaaaugaucgcuaucuagcaacccuaacaguaagaaaucuuguuggcaaaucagaugcagcuguuuuaacuaucccugccugugacuuucaagguuuguaucugugagauggagccugacucuuggguggaaaaauggugguuagguauggacagggcucccauaaaaaacacaaguuaucuaagacugucuccucaguaucagggauaaucacuuguuuauuuuuuaauuuuuuaaauuuuauaaauaaugauuuucuuuuuuucagagacugggucucgccagguugcucaggcuggucucgaacuccugagcucaagcgaucuccccuggccucccaaagugcugggauuaacaggcauaugccaccaaacccagcuagugaucgcauuuuuaggaaucagucagcagacaaauuucaucaggaugcaagaacauuuccaucacuacaugcucacuuaaacuucacaguaagcuacuucauucauuuaagcauauucugauuacuuaccugguuuuuaaaauauuauuucaagauuuugagaacuuuguauacauaugacugaaacguuuaucuguagcuuuauucguagcuuucaaagaagaaaaauugcaauuacaaaccgaaagcauuugaagaauuuagggaaagcaaauuuuuuuuuuucuuuuugagacagucuugcucugucgccuaggcuggagugcaauggcacgaucucagccucugccuccuggcuucaagcgauucuugugcaccagccucccaaguagcuggaauuaaaggcacgcaccacaaugccuggcuaauuuuguauuuuuaguagagacgggguuucaccguguuggccaggcugguuucgaacuccugaugucaagugauccaccugccuuggccucguaaaauguuggaauuacaggaaugagccacagugcccagcggggaagcaaaaucuaaguuuaaaaauugacuacuuuaccuguaaguuauaauaaagugcuuuuaggcaaggaaguauaugcuacaaaaauugauaaaucacauguuuuggaaaugacuguaaaauauggaaauuucaaauuuguuaauauuuauuauuucaauauucaaacuuuguuuuaaagcuacucacccuguaauggaucuuaaagcauuccccaaagauaacaugcuuuggguggaauggacuacuccaagggaaucuguaaagaaauauauacuugagugguguguguuaucagauaaagcacccuguaucacagacuggcaacaagaagaugguaccgugcaucgcaccuauuuaagagguauaccuggcuagaaacaucuaaauugauauccuuuuucuaacucuuuaggcagcuuuuucuuuugcuuauaguguuuugguccguugaaacgacuuccaauuuaucauagccucacuacuuacuagaugugugacuuucagcaagucauacuuaaccucucugaauuacagucucuuuaugaacagagugggguuaauacuuucuucuuuuuguaccccaauaugauuuuaucgucaagggaaaacuccuaaaacuauagaguauagagaaauauaagaguccaaccuuugcugcugauuaguuauauguucucuguaccucauccuucacaugagaaaauaguuuccuagagcaucuggaugacuuguguaaugucuuagaaccaucagauagaggaagcagaacuagaacucagauuuccuuaugucuuucaauuggaaguaguaacaaaggacagaaguaaugaaucguagcgcuccagucuguguguuauggugcugcuuaagugguuauaaagugauacaacaacuuugaagagaaaaaaacucaguuuauagucuuuuguugauaauuaauaauuagaauucagcugugaauaauaugguuaauuagagaaaagcccuaagcagagagauuccugccauaaaguuuuugagcuuuagucauaauacaggcuguuuggacuuacauguuauuaguguacaguuuuaauaagcuugguuaucuaguuuacugacuuuaucaaauuaaaaacaugguggagcuuaggaaguccugaaacaggcuggaaauaacuauagaaacuucuuaaaaaaaaauaaauacagggucucacucuguugccuaggcuagaguaugguggcaugaucauggcugacugcagccuucaacucccaggcugaagugacccuucugccucauccucuggaguaucugggacuacaggcacaugcugccacacucagcuaauuuuauuuuuuuguagagagggaaucucacuguguugcaaaggcugaucuccaacaccuggccucaagcgauucuuuuaccucaaacucccaaagugcugguauuacaggcgugaaccacugcucagagccaauagaaacuuuuuaaagcagcagccgaugcgguggcucacgccuguaauuccagcacuuugggaggcugaggcgggcaaaucaccugaggucgggaguucgagaccagccugaccaauguggauaaacuccgucucuacuaaaacaaaaucagcuaggcgugguggcacaugccuguaaucccagccauuugggaggcugaggcuggagaaucucuugaacccgggaggcggagguugcagugagccaagaucaugccauugcacuccagccugaacaacaagaacgaaacuccaucucaaaaaaaauagaagcuagcauaaguuguggagacauuaaguuuggguagguagucguauguugcucaguaacccugaaagcaucacauuagaguagaauauaaaaauuguucauuuuuugguaauauugaaucauuaagaaaagguaaaaucuguuuaagaagguaaaggagcauguaacuucaugaguaauaguuaaggaauauacauucuuauugaagguauaaauuucaauaaaacauuuucuaauauguacagauaauauacuguauaaauaagaaaaauuuuaguggugcaugcuaaaaaagauaaaaauaaaggaaguuuguuuugguuuuuguuuuuuugagacagagucucacucugucgcccaggcuggagugcaguggugcgaucucggcucacugcaagcuccgccuccuggguucaagugauucuccugccacagccucccaagcaucugggacuacaggugcccaccaccaugcccagcuaauuuuuguauuuucaguaaagggggguuucaccauguuggccaugcuggucucaaacuccuaaccucaagugauccucccaccuuaaccucccaaagugcugggauuacagacgugagccacagcgccuggccgaggaaauuuuuuaagauacccuuuuuuccaacucgcaaacuaggaccguuagugcuuuccccuaggucuuacugcuuuagucgucuugcuccuuaggcuguucucucuuguagguaagacauacaaaaauugucagacucuauaaaauccagaguaauuugagaucauuguuuuauaaauucuaaauguaaauaccaucauuguucuuaacaauguauuuuuuauccacugcauuggcaauacuuuuacagacaguuuuaccugauuaagcuugaauccaguacacaaaagacaaugcuuacuuagaaaacugcaguuuuaaaagaaaauuaaguggucaugaaauuauaauguaaaaauaaauuacgguauuaacuugacuuuuucauuauggaaaaacaugcuuaaucugcuauucuugcuuuagggaacuuagcagagagcaaaugcuauuugauaacaguuacuccaguauaugcugauggaccaggaagcccugaauccauaaaggcauaccuuaaacaagcucguaaguccaaacucacuucuuugaaaaaaaaaguuuagggcuuuguauuaacagaaacauuuuaucgcuuuuaaauaaagauguaucucauuauguucaaaugauuuuaugacaaggaaauuuuacuagauuguaaaugauuuucaguuagcaaauguguucacucuguuacagcaccuuccaaaggaccuacuguucggacaaaaaaaguagggaaaaacgaagcugucuuagagugggaccaacuuccuguugauguucagaauggauuuaucagaaauuauacuauauuuuauagaaccaucauuggaaaugaaacugguaauaaaacuguaucaguuauuaagaaucaguuauuuuuuccuuaagcuuuuaaguacuaauuuaagucuguucuucuuauacaucuuauaguauauuggccucaggagacaccugagaauuugccuuaugguuacuuucauggauuuauugaaaaaguauuguguugugcuuuagaacauaaaauuaugucagaacauuauaaaaguuguuuuccaacaaaaauacuucgcuucuuuuuuaacacuuucacaaugccaaauauaggccaaauaagcaaaagcauugaauaguugaaugaagcacaguucuuauuucuuccagcugugaauguggauucuucccacacagaauauacauuguccucuuugacuagugacacauuguacaugguacgaauggcagcauacacagaugaaggugggaaggaugguccagaauucacuuuuacuaccccaaaguuugguaagaaauaaugaaguuugguuuuuuuucuuucucaaacuuagguuagaaaugaacuuaguuuaugugcuaaaauuguguuaaaaaguacaucuuuggauucaugaugauuuuuauauuaucuggcuuugguuggugguuucuuuauagaaaguguuauuccucaccuuuuugguauuuuauuaacugcuucugacuauauucagcuguacuaaaaauccuaaaagaauuuguguaucuuuccauguggguucauuuuuuucacugguuuggguguguucuuuccuucucuauccucauuucuuucuuuuauugagagauuacuugaaggacuaguccacuuuacagucuucacuuccguaccucccacucaguauuuaacauacugaaauuagggguccuaccccaccccugcacugaaaccucucuggugucacucagaagaccucuugaucaucauauguacugcaugcuuuuuaguuuucaucuuuuuucuacuuuuuuuuuuuggaggcagggucuuacucuguugcccaggcuacaguggagugcaauggcaugaacauggcacacugcagccuugaccuccugggcucaagugauccuccuaccucaguuucucaaguagcugggaccagugccaccacauccagcuaauuuuuuuuauagagauggcuggucucaaacuccugggcucaagugauccuucugccuuggccuccuaaagugcugggauuauagacauaagccacugccuccagccuuuucugcauuugacucuguuggccuuccauccuugaaacucccuccucccuuggguuuucuaaccauacuuuuucugcuagcacagucuccugagucuccuuguucuuugguguuuucuucuucuucuccuuuuuuugcuuuuuuuuuuuuuuuuuuuuuuuuugagacagagucucgcucugucacccaggcuggagugcaguggugcgaucucagcucacugcaaccuccaccucccagguucaagugauucuccuaccucagccucccacguagcugggguagaggugcccacuaccaugccuggcuaauuuuuuguauuuuuguagagacgggguuucaccauguuggcugggauggucucgaccuccugaccucaggugauccaccugccucggccucccaaagugcugggauuacaggcaugagccaccgcacccggccucuugacccuguuuucuuacuugccuauucaaacucuguccauggcuuuagccaucuucucuuuccuucccaaauacauuuucccucccucguucuaugccaaagccauaaauuuaaaugugauuacaauaaauguauuuguauauuuuucucucacauaagcugagugucaaguccuguugauugugcguacccuuucaucaucauuuucuucaacugcaagcuccucaugcuaacuucucuuuucuuagugcauugcccccagugaggucuucaccucaucaucuggcucuucuguaucuucccuaaagcaaacuuaaccaacauucuuucuugcucccccuacauuuugaaucauuauagaaaauuaccuuauuuuaccauaauuguaacccccacccccaagugccagccuaguuaaugauaaguaguaaauuccaugugccuuguugguugaaugcuugcugaaugagggaauaaaugaaugagugacuacauaaaauaaaugauaaaaguuccugagcuuugcuguuagggucaguaaugaauauaguuucugggauaagguuggucccauguggugguauguuaauagguauguuauuuaaaauaaaacuuuauaccauaaucuugagaaaaauuaaaaaauaaacuuaaaaauguauauuuuauguauuucuguggagaccagccaucucuacagagcuuuguauauauguauguguguguguacacacacacauaaaagcccauauguauauuuuuuguuuguuuguuuuugagacagagucuugcucugucucccaggcuggagugcaguggugcagucauagcucacugcaaccucaaauuccugggcucaagcaauccuccugccucagccucccaaguaacuaagacugcugguaggcaccaccaugccuggcuaguuaaaacaauuuuuuugguagagaugggaucucgcuguguugcccaggcugguuuugaacuccuggccucaguccuccugccuuagccucccagagugccggauuacagguaugagccaccaugcucagccuaaaauuuuuuuauuacauagguguucauuauagggaauuuagacuguacaguaaaauguagagaggaagaaaaauuaguccuagucccuuaccccaaaauaacauauuuguguauccuuuuagugucuucuuuguauauauuuuuuuccuaaaauuaaauuauacuuaguauuauuuuauaaccuaccuuuuuucaauucucuaucuguagucucauggauccauuauggcuucuucacauggcuugagucuugccaacgaggaccuuacagcuuaguugaagaaauuuugcauaaguaaaucagaaaaaggagaaccuguggacuauguagacaguaaauagaguaggaauuuaaauauaccaguaguggauaauuuuaccuucaaagguuuuaugaagaagaaaauacuugagccuugaguuaguauguggacaaauaggaagaagguggcaucuuagagagcagcaugagcaaaggcacaggcuugaaaacauaaaagcagauguuuaauaaagcaaaguuucugccuaaauuagauuuggcauuuuauauauauauacacacauacauacccauaucaauauauauauacacacauauaucaauauauacacacauaaauauauauacauacacccauauauauauauauaugaugcuuagcauuuaagaguuaauauuugccaacccauaguuuauucucaagcauuuaacugauuucuugauuucuacugagcuucauaggauguuaguuacuuacaaagggauaugugugguggaaggauaaaauuaagugaauaguauauggcugcaauauuacuuucauacauuuuuuacuguaaaagacuaaguaaaauucaaaauuaaucaggacagucauuuaaaaaaucuccaauguuaauuaucccaauuagugauuaauuugaugaacaaguccucuuuuaaaugcagaugaggauuugugugguauuuagggaucuuaggcuuguuuacuuuuuaguuuauuccuacucgugccacuccucaugcccauugagcagcuccuaaaguucuuagcccuguaccagcuauauccuccuuuugaaaaaugguaaauaacucuuaaaacuucugagaguugcauuuuuauuuuuuagaagguuaaauguguaguucaauuauguuuuuauagcuuuuccauuuuacccaguauuuauauuuguucugacauaauuucucuguuauacaguauuagaacucagagauaaacuuuuacuaagauucuaccaaaugcagaucauaaauguuacaaaugguuauguuugaaagcucuaacccaguagauuacccgauacacugaucauuuuuaucccccaaccaacauauauuuuaugcuaugcggccagguuaauguauaagacauaaaugguugggaugugauuuaccaaagagagaagaggguaaaaaucaucaagucugaagagaccuugaaaaauaauuaggauuguauuuuaucuuuucaacaguaagucugguugggaaguuguauuaugucuucuuaguucauaugucaacauuauuucccaucacaccucuuuuuuuuuuuuuuuuuuuuuuuuuaagcucaaggagaaauugaagccauagucgugccuguuugcuuagcauuccuauugacaacucuucugggagugcuguucugcuuuaauaagcgagaccuguaaguaacuuuauucauauuuuugcauuuucccccagcuuuauugagcugaauuuacaugcaauaaaauuuauccauuuuaaguguacaguuugaugaauuuuuguaauuacauacagauguauaacuaccaccauaaucacaauauagaacauuuucaucacuuuuauaaagcuuccuuguucuccuuuguaaucugucuucuucucagcccaaccccaggcagucauugaucugcuuuucuguaacuguaguuuugccuuuucuagaauuuuuauuuaucuaucuauuuugagacagaguuucacucuuguugcccaggauggagugcaguggugcgaucucaguucacuacaaccucugccucccugguucagacuccugccucagccuucaaaguagcuaggauuacaggcgcccaccaccacacccagcuaauuuuuuguauuuuuaguagagaugggguaucaccauguuggccaggcuggucucgaacuccugaccucaggggauccacccucagccucccaaagugcugggauuacaggugugagccacggccaagaauuuuauauaaauagaaucacauagcguguagucuuuugcguaugucuuuuacauaauauuuuugagauucauccaugauguugcauauacuucucccuuuuuuuuuuuuugagauggagucucacucuguucccuuacuggaguacaguggcaugaucuuggcucacugcaaccucuaccuccugaguucaggugauucuccugccucagccucuugaguaacugggauuacaggcacuugccaccaugcccagcuaauuuuuguauuuacaguugagacggaguuucaucauguuggccaggcuggucucgaacuccggaccucaagugauccacccaccuuggcuucccaaaagugcugggauuacaggcaugagucaccacaccuggccuaccuuuuuccuuuuuauugcugaacaguauucuguaguauggauauaucaaaacuuagacugaucuguuauggaaguuuagguuguuucuaauuuuuagcuauuauaaauaauguugcuaugaauauucacauacaaaacugugcgagcauauguuuuccuuuaucuugaacaaauaauaggagugagagugcugggucauaugguaaguauauguucaacuuuauaagaaacugccaaacuuuuucagaguggcuacaccaucuuggauugccuccagcaguguuccauauuaucaccaacacuuagugcugucagacuucuuucauucuaguggguguguaguacuauaucguuuuaauuuucauuucuccgaugacuaguaauggaucuuuucaugugucacuuacauauuuucuuuugugaugugucuauugaaaucuuuuacccauuuucaaauuggguuauuuuguuuauaauugagcuauaagagugcuuuauauguucugguuacaacauuguuaaauacguuuugcaaacuuuugucccagucugugcuuuguuuuuuugucuuaacuguggcuuuagaaaagcagaaguuuuacgccuguaaucccaccacuuugggaggucaaggcgggcggcucacaaggucaggagauugaggccauccuggcuaacacaguggcuaacaucucuacuaaaaauacaaaaacuuagccgggcaugguggcacacgucaguaaucccagcuacucgggaggcugaggcaggagaauugcuugaacccaggaggcauggguugcagugagccaagaucacaucacugcacuccaaccugggugacagagugucugaaaaaaaaaaaaaaaaaaaaaaaaaaaagcauaaguuuuuuauuuugaugaaguucauuuuaucaguuuuuuuucugugguuccugaguuuuguguccugccaaacacaguaucaaaauauuuucucauguuuucuuccauaaguucaauaguuucagcucuuagucuaugauccauuucagguuauuuuugugcauggugugaggucagggucaagguucauuuuguuccuucagaugucuaauuccauugucauuuauuuugaaaagagugucuuuuccccauugaauugcuuugguaccuuugccaaaagcaauugucuuuauaagucuguaucuauuuccauacucucacuucuguuucauaaauguauauauguccguucuuaugccaauaccacauugccuugaugaguauagcucuauaguaaauuuugaaaauagguagaauucuuccaguguguucuuuuuuuaaagaaguuauuuuggcuagguucuuugccuuuucauauacauuuuaauucagcuugucaacuuuuuuaaaacuauaguuuugauugggauuuuauugaaucuauaggucagauuuaauugaaucuauaggagagaacugcagucuuuuuuuuuuuuuuuuuuugauuuaauuccucagcuaaaacagcggaagaggugauuuauuauaugguuguuacacucggccacaaauaaacacagaaauaguccagaaugucacagguccagggcagaggaccaacaugggcauuuuguuuuugagcaaggugggucucagaggugaucggcgaucagagggcgaugaaguucuagauccauugagacaagcucuagacaguagcaugcagucccacaacuuguaccagcauccccagcgucuggcauuccauguuucugcuccuguggccuccacggugcaacaagcuagcgguuuacuuggaccucugccucaucuuucuucuuuugcgcuucagccugcgcauucgcuucuuccuccacuuggcucucauggcgccgagguuuccaaaaaaauggcgcuaaggccgagagagaacugcagucuuaacgcuacugagucuuucaauccgugaaccugguuuauuucuuuauuuauuuggguuuuguuuaauuuacuuuugcaguguuuuguaguuuucaguagacaggccuugcauaacuuuuuuugaauucaugacaaaaguauuuuuuguuauuauaaaugaaauguuuaaaaauauuuucuaauucuuaguauauagaaaugcaauugauuuuuuaaaauauauucaucauguauacugagacuuugauaaauucauuuauuaguagcuuuuuggauccuuaggauuuucuagauacacaaucaugcuucuugggaguaauuauaguuguucuaaucuuuaugcuuuuaguucuuuuuauugucuuaaugcacuggcuaagaccucuaguacauauaguacaucuagaccauauaagagcauugcuuuguuccuaauuuuagaggugaaaguauuuagucuuucaccaucacaugugauguuagcuguagguugaaguuuuugcuuugugggguuuuuuuguuuugagacugaguucuacucuuguugcccaggcuggagugcaguggcacaaucuuggcucacugcaacccccaccuucuggguucaagcaauucuccugccucagccacccgaguagcugggauuacaggcaugcaccaccaugccuggcuaauuuuuuuguauuuuuaguuuaguagagauggggguuucaccauguuggccaggcuggucuugaacuccugaccucagguaauccacccaccucagccucccaaaguguugggauuacaggugugagccaccgcgcccagccgcuuuguguuuuuuuuuccccuuuacuacuacuugcaggggggaaguucuuauuucuguuuugccuugcuagcaauuuuuaucaugaaugggugucacaauuuggucaaaugcuuuuucugaaucuauugagaugaucauaugguuuuucuccuuccuuccaugaauauggugcauuuuauugauuuuucauauaacaucuuugcauuccuuggauuuugcugcauucaguuuaauacuguuugcaucuguguucaugagugaaguuagucugucuuuaugugccuuaucugucugguuuuaaaaucaggauaauacuggccucauaaaaugaaugggaacauguuaccuccucuguuuucugaaagaguuuguauaguauuaauacaauuguuuccuuuugcccagaguuuugugggaagguuuuuaauuaaaaauucaauuucuuuauaaauauagcuuucuuuuucuucaaucuguuuugguaauuugugucuuucaaggauucauucauugguuugucuagguugucagcuuuacuacuuuuuauauuacuuccaaauguuauagguauuuccuacaggagagucagucugguaggcucucacucuuugaagcaccauucucagucacuuuuuuaaauuugauuuuuauauuugaacuuuuuugguaucagugggaacauuaauuuguuaucuggauucuuuuaauuggaauaccacaacauguggccuggguaaagauuuuaagugguuuuaauugcagaauuuugagaguuuaaaaaaaaauuugaacacugauuagauuuagcuuuguuaauucauuaugaauacauuauaauccuuaugcauuuucaacaguauuuuucuauugguuauaagaaaaauaauuuuuguuugggguagaguagguauuuuuuguucauuuagguaauugguuugguuuguaagagucuuugaugaacauguuuagaaauagggacuauuuauuguuuauuaugugugguuuuacauaggccauuuuucuuuucucuucagaauuaaaaaacacaucuggccuaauguuccagauccuucaaagagucauauugcccaguggucaccucacacuccuccaaggguaagagaaaaugcuucugaguuguuuauaauauacagacauguuaguagguauauugaguaucuacaguuaguagguauauugaguaucuacaaauguaccaaaagauaagauauucaagcugaaucaaaaaguaaaugaagauaaaacaguacauaacugaaaauuuuaaucaaaauuuaauauguaugacauauuuuagggguuuuaucaccaucauaguauauuuguucugauauuuuaaauuguuuaguacacauuacagauguuugguugaacuugcaaacugaaaacuugaggugcugaaacugcuaugugaugguaacuaccucaagcauuuuggguugaguauuaaaaccaaguucaacaguuuaucauuuuagcacugaugaaaugaucucugggaaccuacucuaaacucugaauuuuaaauaugccccaaaggggaacucauuuauauuuauuauccuccgguaguccuuaaauuuuauauuaacagauuaaaauguauuauguauuuuuauauucuacaaaaucucugucauucagguuugauuuuccuuaauguuuucuaguuuucuguccaguuaauccuaggcugccuagucuaggcaugaaauauuaaauacuacuuguagaccauuagcuuaucaaaauguaacaccaacaauauugauuuagacuacuuagacucauuuuauaguaucugcauuuuggguaguugacagugacuuagugacauaauacagguuauuucuguaccacugagaguuacugggaaguuucagagaugcauuagcucuguggcuuuaacuaauacuugccauauacaauuuuuucucuuccuuagcacaauuuuaauucaaaagaucaaauguauucagauggcaauuucacugauguaaguguuguggaaauagaagcaaaugacaaaaagccuuuuccagaagaucugaaaucauuggaccuguucaaaaaggaaaaaauuaauacugaaggacacagcagugguauuggggggucuucaugcaugucaucuucuaggccaagcauuucuagcagugaugaaaaugaaucuucacaaaacacuucgagcacuguccaguauucuaccgugguacacaguggcuacagacaccaaguuccgucaguccaagucuucucaagauccgagucuacccagcccuuguuagauucagaggagcggccagaagaucuacaauuaguagaucauguagauggcggugaugguauuuugcccaggcaacaguacuucaaacagaacugcagucagcaugaauccaguccagauauuucacauuuugaaaggucaaagcaaguuucaucagucaaugaggaagauuuuguuagacuuaaacagcagauuucagaucauauuucacaauccuguggaucugggcaaaugaaaauguuucaggaaguuucugcagcagaugcuuuugguccagguacugagggacaaguagaaagauuugaaacaguuggcauggaggcugcgacugaugaaggcaugccuaaaaguuacuuaccacagacuguacggcaaggcggcuacaugccucagugaaggacuaguaguuccugcuacaacuucagcaguaccuauaaaguaaagcuaaaaugauuuuaucugugaauucagauuuuaaaaagucuucacucucugaagaugaucauuugcccuuaaggacaaaaaugaacugaaguuucacaugagcuauuuccauuccagaauaucugggauucuacuuuaagcacuacauaaacugacuuuauccucagacuagcugaaugauuuugugcuguuucaggauguuugcacugaagaaaaacagaaagcuuaucugaaauuuauaaaacuuuuuguuuugcuacauagaaaacagaagguauuugaauaauaagcagugauaugcuuagugagcacagcuauacugauuuugauuagaauagucaucagaguggcuuagggacaguuaauauaaaagaggagcaagguguagaccaucaucuacuucugcuaaaauaacuuaaaaagagguccauaggccauaacuacaugagcccagcuuuuguaaucugacaaaaaaaugaggagcagcuucguguauaucaguguacacgguauuccuuaggucccuuccauugguagugaugcugcgaguuauuacuggagaaaaggaauucuagagcuuuaacuuggcagauuaaaaguacucauuuuuuauucaucaauaauuaguaaucucacuaguuuucaaaaauuugcauauuauugacaaccucuuugaagaugcauuucacaaacucaacagagugccaugauaagagcuagggaucccccaaacuaucucaagcaucuaaaaaauugccauuuuuaaaggcuuaaauuguaguaguaaaggggaaaacaggaaguaguaguaaaggggaaaaaaaaccaauaaagcaucuaaaaaauuggcauguuaaaaggcuuaaauugcuaauguguguauauauauauauauauauacacacacauaucauugacuuuucuuaagacuucagaguacuggguagaugaacacuuuauacaguauauaucuucagcuuaaauuuguuuugaguauuuuuuuuauuuuuaaauaaguaggcaaagauuuaaauuuuuuuauuuuuaguaaauguuugaggcacacuaagacaacuugggcaauauuugccaaaacaaaacagaaccccaaaaaauguacaucuuguucuuagcaaauaucauuauuguagagacacuuaauaaagagaugguauuuuaaugucugcaguucugagguaggguggaacuuaguucuacauugugauuuaggaauuuuuaaaaccuuuuuucuucaagggagaagugacccaggccucgaguuuagugcuaaagccgcuaguguacuuaugcuguccccuaaccaccacgugcgauauggaagcagaugcuaaauauagggguuuucuuagaaaguaagaggaaauuagcaagcguuauuagugauugacuacugcuaucaagugaauucaaaggaaacagguuuuuaugccauauuuaaguuacagaaaccaggcaugcuuagaauaguuucuagagguuauuggagaauagaaagcuaagaaaacuugguauacauuuacaauggaaauauaauuacacuuuuuacucucagaauauuguucacauuagacuuccuguuuaucuuuuauauucuugcauuuauauaaugccucauccuuucaaaguucuuucacauauuauaugaucuucuuuaugaaaaaaauagauguuucauucugauauauucaguuucccacuuuaggcaaaaguagauuaauagaaugacgaauucaaaguagaugaggaaaaucaggcacagagaaguaaagguagggauagacccaaauuuacacaacaagauaaugacaucuccagcuuuuaaguugaucaucaaaggcugggcuggauuugucuugcuguaugugucaggaaauuuauaccuauuacauuuuccauuuucucaaaauuuaagucacaugacuaauauuuagcugcaacuuuccucauaacaaauagugucaugaagaauguuguagugugaaguuuguacauuucagggucagauauacaauaugaacucuuaaucuacaggaaugagaauggaggaucauugaaggccaugauauaaacaaauuugcauguugaagccuguauaaaacaugguacagugagugaauauacccccauccccaagaacacuuuauacauauuaaauggauauaugauuacugugcaaaaauucauucuggaaaugaacauauauuugagcacuaauauguaauguacaccugcccuaaggagaaaauaaauuauaaaacuuuuuacauucaaaauuacuuucccaagcaugucuuagaauaaucuauguguugaugcauguaaauuguacuuuagguaggcaaagaaaucugguuauuuauguaaaaacuagucuaauaaaguuaguuaguggcuuuaucacuuuaaaucuuuaguguccaaaagugguguuuaaaguaauagcacaucagaaaaccuugucuggacaaaacuaguucacucacugcuucugcaccugcaguugcucccuuuaggguuauaaaauaaugacccaaauguuacauguguugauauuauaacuugucaguuacugaugucugugguauccuacccucaucucugaaagggauaauacugaauaauuauuagaaaacuauaaaacuucacacuuuguaccauuaaaaccuaaaauuuuaaucuuguccuuuuuuacuauggaucagucggcacucgggaacagcagcaaggaaaaaaagcaaauuucauucacauguucuguguucauaccucuucucuaccuaauuguucauuuaaauuucagccuuauuccuugauaagggauuuuaccacaugaagucauccagugacccuagcucuuauugugaaguuaguggaguauacuuagaaauguuacaacuuuaaaauguuacaaaacauucauuaaagcucauauuuaaaguagagcaucuaguuugagaaauagaaaucaauuauuaaagaugucuuuuuucuacccauuuaacuaguuaaaaccaugacauguaaauguagaaguagaauaaucauagaauucccuaaaauauuucuguuuacuaacauauauugaccaaguacaucaagcaggagagaucuuccuucauucuguuauaguccacaucauucuaauuuugcucaguuguuauuaagagcauauuccuaaaccauacacuuuuguuucaauaaaguuuuauuuuguugagaugaauaaaauaacaaaguuauaagcugcauaagacaaaaguucaauuguucaaaaaaaauuuacugggauagcuuucuauuacagguauuguuagauuauauugugcugauaagauuacuuucuaaaaaauuuguacuuuucuguaaauuaaaagaauauggagucauaaaauggcaaguguuuuaggauuagccuaaaauuggacauugucauugauuucaaagaagguaugaacuagcagucuuacagccuaauucuucuuuggacugguccuuggcagcaguuccuuuucagacucgauaaacagaauucagaugauguaagucaaaacaaaacuuuacaaagccaagcguauuaucuuuugcauuaaccuauuuuuuuccaucauacaugcuacuaguaugugcauuagcaugauauucucauauacauugcauuaaaaauuaaaagguggcagcucagggugagcucuucuguugcucauuuguuccuaaauuuuuaagggcuuuuucucagucaauaguuuguacaaacugguuaguuuaacuucauuacccauuucauuaaaguugaugggucgugugaugagaugcauuuaaggccgauagugauagauguuuuuuuuauuucuugaacacaggcuuugucugaaugauguucuuuuaucucuugaacacaagcuuugaaugauaacuacagguuuuaagugcuguuacauuaauaccauaaugugauguguuagaaacaaagggauauuucaaagguagauauuugaaaauucucuagucucaauauguauguguauugaauauacucuaaaaauaaaugugcaauuugcuaguaggacaaugcagugacugacuagcauuagguauguuucuuuuauauccuagcuaugucccacuuucuucuaagugcaauccuuucauguucacuugcuguuuuaccccaucuacucuaacuucauuuggaaggcuugucuagaguauagcauguauuuuuaccuuugcagugaauugcaugugcuaauuguaaccacagcuauuuuuauguugacauaacuccaaauguuauauuaaauguucuauuauauauuagcucuaaucccuuaaguaaauuuuaagaaauaaauacuuguucaaauuuuuuuucuguaugugguuacuaucaucugacuaugcauauuuguaacagcauuuaucauuagugguguuagcuaaauaagcaucuuaguguaaaugagaugcuucguguggguuuugugacauuuuaaaugacauaauggaaugugauuuaaaagaaaaccaguacacuaucuuggucuuaauaacauagaauggagauggcaaauuuauccacuaguuuuccagauuuacuauuuaauagcugaggucugaaaucguagcauccucccuccuaguggacauuaaaaaaaaaaaaaaaaaaaaaaaccuacuugguugucaagagcccaaguauggaggugcugcgccaucuuguggccugucugugcccacccugcacucugcuggagucuccauccuuguugcagugagacuugaaguucaagauugauacauggcauccuccugcuacuucuugagguuacuaaguaguauaugaaacuaaucagucagcaaguccaccuggaaggaaaagaaaaucucaacuauuaaugugccuucacauugugauuuugucuaaaaaaauguagugagucaaaaaacccacaagccagccaacaguaacuccuucacauauauaccagaguuuauagaaauaacaugucagcuuugggcuaugugcuccuuuguuuaaaaucuucuauuugguuauggcuuguauaggcucaagccugauuucuuuaaggugugguggcucaucuuauccuaauguguaugauagauacaguccauccugcuuuggaaaagauuauguaacuccuugagagcauacucuuucucuagcccaaaggcagugagagaguuuucuuguucaggauugcuuaacuuuccauuuaagcuuuuucuuuuuaaauuaauacaaacuucuacacuuucaaaauacgaaauauauuacaacugcguauaggcucuuccauacuuaaguccagugcuugggcaaguuaauggagugaaagacuacaagcaaagaggaacugagguagaaaaagaagaaugugugaaagcagcaggaagcucagccaacucgaaagcagggugaacagcuugaguccuguugcugcugaucgggguuggcucuuggacaacuuaguaagaucauggaaaggcugcuuggguucuccauagaaaaguucugucuccaucaagggaggaaaauguaccuuucaacucaaaauucaauauuuguuuuuaaauauagcuauuuuccccaaccgcuaaagauuuucaacagauacgaagccagagcuuaguuuuagaaaccuguggacauucaaaccugauucuuuauucccugugacuaugguuaugucauuuuacaugucaaaaaaguguaucuagaauugucauuucuuauuuuugagcuuuuuuuagugagaauuauccccucacuuaaauggcuuuuuauuuaaacaucugugcauucuguaugaaauuguagucuuucugggauaacauggugagcuauauggugguaauccacacacacaaaaauaaaagccaaaaaaaaaccaa

SEQ ID NO: 192458 - RNA, 59897 nt, Homo sapiens
uugguuuuuuuuuggcuuuuauuuuuguguguguggauuaccaccauauagcucaccauguuaucccagaaagacuacaauuucauacagaaugcacagauguuuaaauaaaaagccauuuaagugaggggauaauucucacuaaaaaaagcucaaaaauaagaaaugacaauucuagauacacuuuuuugacauguaaaaugacauaaccauagucacagggaauaaagaaucagguuugaauguccacagguuucuaaaacuaagcucuggcuucguaucuguugaaaaucuuuagcgguuggggaaaauagcuauauuuaaaaacaaauauugaauuuugaguugaaagguacauuuuccucccuugauggagacagaacuuuucuauggagaacccaagcagccuuuccaugaucuuacuaaguuguccaagagccaaccccgaucagcagcaacaggacucaagcuguucacccugcuuucgaguuggcugagcuuccugcugcuuucacacauucuucuuuuucuaccucaguuccucuuugcuuguagucuuucacuccauuaacuugcccaagcacuggacuuaaguauggaagagccuauacgcaguuguaauauauuucguauuuugaaaguguagaaguuuguauuaauuuaaaaagaaaaagcuuaaauggaaaguuaagcaauccugaacaagaaaacucucucacugccuuugggcuagagaaagaguaugcucucaaggaguuacauaaucuuuuccaaagcaggauggacuguaucuaucauacacauuaggauaagaugagccaccacaccuuaaagaaaucaggcuugagccuauacaagccauaaccaaauagaagauuuuaaacaaaggagcacauagcccaaagcugacauguuauuucuauaaacucugguauauaugugaaggaguuacuguuggcuggcuuguggguuuuuugacucacuacauuuuuuuagacaaaaucacaaugugaaggcacauuaauaguugagauuuucuuuuccuuccagguggacuugcugacugauuaguuucauauacuacuuaguaaccucaagaaguagcaggaggaugccauguaucaaucuugaacuucaagucucacugcaacaaggauggagacuccagcagagugcagggugggcacagacaggccacaagauggcgcagcaccuccauacuugggcucuugacaaccaaguagguuuuuuuuuuuuuuuuuuuuuuuaauguccacuaggagggaggaugcuacgauuucagaccucagcuauuaaauaguaaaucuggaaaacuaguggauaaauuugccaucuccauucuauguuauuaagaccaagauaguguacugguuuucuuuuaaaucacauuccauuaugucauuuaaaaugucacaaaacccacacgaagcaucucauuuacacuaagaugcuuauuuagcuaacaccacuaaugauaaaugcuguuacaaauaugcauagucagaugauaguaaccacauacagaaaaaaaauuugaacaaguauuuauuucuuaaaauuuacuuaagggauuagagcuaauauauaauagaacauuuaauauaacauuuggaguuaugucaacauaaaaauagcugugguuacaauuagcacaugcaauucacugcaaagguaaaaauacaugcuauacucuagacaagccuuccaaaugaaguuagaguagaugggguaaaacagcaagugaacaugaaaggauugcacuuagaagaaagugggacauagcuaggauauaaaagaaacauaccuaaugcuagucagucacugcauuguccuacuagcaaauugcacauuuauuuuuagaguauauucaauacacauacauauugagacuagagaauuuucaaauaucuaccuuugaaauaucccuuuguuucuaacacaucacauuaugguauuaauguaacagcacuuaaaaccuguaguuaucauucaaagcuuguguucaagagauaaaagaacaucauucagacaaagccuguguucaagaaauaaaaaaaacaucuaucacuaucggccuuaaaugcaucucaucacacgacccaucaacuuuaaugaaauggguaaugaaguuaaacuaaccaguuuguacaaacuauugacugagaaaaagcccuuaaaaauuuaggaacaaaugagcaacagaagagcucacccugagcugccaccuuuuaauuuuuaaugcaauguauaugagaauaucaugcuaaugcacauacuaguagcauguaugauggaaaaaaauagguuaaugcaaaagauaauacgcuuggcuuuguaaaguuuuguuuugacuuacaucaucugaauucuguuuaucgagucugaaaaggaacugcugccaaggaccaguccaaagaagaauuaggcuguaagacugcuaguucauaccuucuuugaaaucaaugacaauguccaauuuuaggcuaauccuaaaacacuugccauuuuaugacuccauauucuuuuaauuuacagaaaaguacaaauuuuuuagaaaguaaucuuaucagcacaauauaaucuaacaauaccuguaauagaaagcuaucccaguaaauuuuuuuugaacaauugaacuuuugucuuaugcagcuuauaacuuuguuauuuuauucaucucaacaaaauaaaacuuuauugaaacaaaaguguaugguuuaggaauaugcucuuaauaacaacugagcaaaauuagaaugauguggacuauaacagaaugaaggaagaucucuccugcuugauguacuuggucaauauauguuaguaaacagaaauauuuuagggaauucuaugauuauucuacuucuacauuuacaugucaugguuuuaacuaguuaaauggguagaaaaaagacaucuuuaauaauugauuucuauuucucaaacuagaugcucuacuuuaaauaugagcuuuaaugaauguuuuguaacauuuuaaaguuguaacauuucuaaguauacuccacuaacuucacaauaagagcuagggucacuggaugacuucaugugguaaaaucccuuaucaaggaauaaggcugaaauuuaaaugaacaauuagguagagaagagguaugaacacagaacaugugaaugaaauuugcuuuuuuuccuugcugcuguucccgagugccgacugauccauaguaaaaaaggacaagauuaaaauuuuagguuuuaaugguacaaagugugaaguuuuauaguuuucuaauaauuauucaguauuaucccuuucagagaugaggguaggauaccacagacaucaguaacugacaaguuauaauaucaacacauguaacauuugggucauuauuuuauaacccuaaagggagcaacugcaggugcagaagcagugagugaacuaguuuuguccagacaagguuuucugaugugcuauuacuuuaaacaccacuuuuggacacuaaagauuuaaagugauaaagccacuaacuaacuuuauuagacuaguuuuuacauaaauaaccagauuucuuugccuaccuaaaguacaauuuacaugcaucaacacauagauuauucuaagacaugcuugggaaaguaauuuugaauguaaaaaguuuuauaauuuauuuucuccuuagggcagguguacauuacauauuagugcucaaauauauguucauuuccagaaugaauuuuugcacaguaaucauauauccauuuaauauguauaaaguguucuuggggauggggguauauucacucacuguaccauguuuuauacaggcuucaacaugcaaauuuguuuauaucauggccuucaaugauccuccauucucauuccuguagauuaagaguucauauuguauaucugacccugaaauguacaaacuucacacuacaacauucuucaugacacuauuuguuaugaggaaaguugcagcuaaauauuagucaugugacuuaaauuuugagaaaauggaaaauguaauagguauaaauuuccugacacauacagcaagacaaauccagcccagccuuugaugaucaacuuaaaagcuggagaugucauuaucuuguuguguaaauuugggucuaucccuaccuuuacuucucugugccugauuuuccucaucuacuuugaauucgucauucuauuaaucuacuuuugccuaaagugggaaacugaauauaucagaaugaaacaucuauuuuuuucauaaagaagaucauauaauaugugaaagaacuuugaaaggaugaggcauuauauaaaugcaagaauauaaaagauaaacaggaagucuaaugugaacaauauucugagaguaaaaaguguaauuauauuuccauuguaaauguauaccaaguuuucuuagcuuucuauucuccaauaaccucuagaaacuauucuaagcaugccugguuucuguaacuuaaauauggcauaaaaaccuguuuccuuugaauucacuugauagcaguagucaaucacuaauaacgcuugcuaauuuccucuuacuuucuaagaaaaccccuauauuuagcaucugcuuccauaucgcacguggugguuaggggacagcauaaguacacuagcggcuuuagcacuaaacucgaggccugggucacuucucccuugaagaaaaaagguuuuaaaaauuccuaaaucacaauguagaacuaaguuccacccuaccucagaacugcagacauuaaaauaccaucucuuuauuaagugucucuacaauaaugauauuugcuaagaacaagauguacauuuuuugggguucuguuuuguuuuggcaaauauugcccaaguugucuuagugugccucaaacauuuacuaaaaauaaaaaaauuuaaaucuuugccuacuuauuuaaaaauaaaaaaaauacucaaaacaaauuuaagcugaagauauauacuguauaaaguguucaucuacccaguacucugaagucuuaagaaaagucaaugauauguguguguauauauauauauauauauacacacauuagcaauuuaagccuuuuaacaugccaauuuuuuagaugcuuuauugguuuuuuuuccccuuuacuacuacuuccuguuuuccccuuuacuacuacaauuuaagccuuuaaaaauggcaauuuuuuagaugcuugagauaguuugggggaucccuagcucuuaucauggcacucuguugaguuugugaaaugcaucuucaaagagguugucaauaauaugcaaauuuuugaaaacuagugagauuacuaauuauugaugaauaaaaaaugaguacuuuuaaucugccaaguuaaagcucuagaauuccuuuucuccaguaauaacucgcagcaucacuaccaauggaagggaccuaaggaauaccguguacacugauauacacgaagcugcuccucauuuuuuugucagauuacaaaagcugggcucauguaguuauggccuauggaccucuuuuuaaguuauuuuagcagaaguagaugauggucuacaccuugcuccucuuuuauauuaacugucccuaagccacucugaugacuauucuaaucaaaaucaguauagcugugcucacuaagcauaucacugcuuauuauucaaauaccuucuguuuucuauguagcaaaacaaaaaguuuuauaaauuucagauaagcuuucuguuuuucuucagugcaaacauccugaaacagcacaaaaucauucagcuagucugaggauaaagucaguuuauguagugcuuaaaguagaaucccagauauucuggaauggaaauagcucaugugaaacuucaguucauuuuuguccuuaagggcaaaugaucaucuucagagagugaagacuuuuuaaaaucugaauucacagauaaaaucauuuuagcuuuacuuuauagguacugcugaaguuguagcaggaacuacuaguccuucacugaggcauguagccgccuugccguacagucugugguaaguaacuuuuaggcaugccuucaucagucgcagccuccaugccaacuguuucaaaucuuucuacuugucccucaguaccuggaccaaaagcaucugcugcagaaacuuccugaaacauuuucauuugcccagauccacaggauugugaaauaugaucugaaaucugcuguuuaagucuaacaaaaucuuccucauugacugaugaaacuugcuuugaccuuucaaaaugugaaauaucuggacuggauucaugcugacugcaguucuguuugaaguacuguugccugggcaaaauaccaucaccgccaucuacaugaucuacuaauuguagaucuucuggccgcuccucugaaucuaacaagggcuggguagacucggaucuugagaagacuuggacugacggaacuuggugucuguagccacuguguaccacgguagaauacuggacagugcucgaaguguuuugugaagauucauuuucaucacugcuagaaaugcuuggccuagaagaugacaugcaugaagaccccccaauaccacugcuguguccuucaguauuaauuuuuuccuuuuugaacagguccaaugauuucagaucuucuggaaaaggcuuuuugucauuugcuucuauuuccacaacacuuacaucagugaaauugccaucugaauacauuugaucuuuugaauuaaaauugugcuaaggaagagaaaaaauuguauauggcaaguauuaguuaaagccacagagcuaaugcaucucugaaacuucccaguaacucucagugguacagaaauaaccuguauuaugucacuaagucacugucaacuacccaaaaugcagauacuauaaaaugagucuaaguagucuaaaucaauauuguugguguuacauuuugauaagcuaauggucuacaaguaguauuuaauauuucaugccuagacuaggcagccuaggauuaacuggacagaaaacuagaaaacauuaaggaaaaucaaaccugaaugacagagauuuuguagaauauaaaaauacauaauacauuuuaaucuguuaauauaaaauuuaaggacuaccggaggauaauaaauauaaaugaguuccccuuuggggcauauuuaaaauucagaguuuagaguagguucccagagaucauuucaucagugcuaaaaugauaaacuguugaacuugguuuuaauacucaacccaaaaugcuugagguaguuaccaucacauagcaguuucagcaccucaaguuuucaguuugcaaguucaaccaaacaucuguaauguguacuaaacaauuuaaaauaucagaacaaauauacuaugauggugauaaaaccccuaaaauaugucauacauauuaaauuuugauuaaaauuuucaguuauguacuguuuuaucuucauuuacuuuuugauucagcuugaauaucuuaucuuuugguacauuuguagauacucaauauaccuacuaacuguagauacucaauauaccuacuaacaugucuguauauuauaaacaacucagaagcauuuucucuuacccuuggaggagugugaggugaccacugggcaauaugacucuuugaaggaucuggaacauuaggccagauguguuuuuuaauucugaagagaaaagaaaaauggccuauguaaaaccacacauaauaaacaauaaauagucccuauuucuaaacauguucaucaaagacucuuacaaaccaaaccaauuaccuaaaugaacaaaaaauaccuacucuaccccaaacaaaaauuauuuuucuuauaaccaauagaaaaauacuguugaaaaugcauaaggauuauaauguauucauaaugaauuaacaaagcuaaaucuaaucaguguucaaauuuuuuuuuaaacucucaaaauucugcaauuaaaaccacuuaaaaucuuuacccaggccacauguugugguauuccaauuaaaagaauccagauaacaaauuaauguucccacugauaccaaaaaaguucaaauauaaaaaucaaauuuaaaaaagugacugagaauggugcuucaaagagugagagccuaccagacugacucuccuguaggaaauaccuauaacauuuggaaguaauauaaaaaguaguaaagcugacaaccuagacaaaccaaugaaugaauccuugaaagacacaaauuaccaaaacagauugaagaaaaagaaagcuauauuuauaaagaaauugaauuuuuaauuaaaaaccuucccacaaaacucugggcaaaaggaaacaauuguauuaauacuauacaaacucuuucagaaaacagaggagguaacauguucccauucauuuuaugaggccaguauuauccugauuuuaaaaccagacagauaaggcacauaaagacagacuaacuucacucaugaacacagaugcaaacaguauuaaacugaaugcagcaaaauccaaggaaugcaaagauguuauaugaaaaaucaauaaaaugcaccauauucauggaaggaaggagaaaaaccauaugaucaucucaauagauucagaaaaagcauuugaccaaauugugacacccauucaugauaaaaauugcuagcaaggcaaaacagaaauaagaacuuccccccugcaaguaguaguaaaggggaaaaaaaaacacaaagcggcugggcgcgguggcucacaccuguaaucccaacacuuugggaggcugagguggguggauuaccugaggucaggaguucaagaccagccuggccaacauggugaaacccccaucucuacuaaacuaaaaauacaaaaaaauuagccaggcaugguggugcaugccuguaaucccagcuacucggguggcugaggcaggagaauugcuugaacccagaagguggggguugcagugagccaagauugugccacugcacuccagccugggcaacaagaguagaacucagucucaaaacaaaaaaaccccacaaagcaaaaacuucaaccuacagcuaacaucacaugugauggugaaagacuaaauacuuucaccucuaaaauuaggaacaaagcaaugcucuuauauggucuagauguacuauauguacuagaggucuuagccagugcauuaagacaauaaaaagaacuaaaagcauaaagauuagaacaacuauaauuacucccaagaagcaugauuguguaucuagaaaauccuaaggauccaaaaagcuacuaauaaaugaauuuaucaaagucucaguauacaugaugaauauauuuuaaaaaaucaauugcauuucuauauacuaagaauuagaaaauauuuuuaaacauuucauuuauaauaacaaaaaauacuuuugucaugaauucaaaaaaaguuaugcaaggccugucuacugaaaacuacaaaacacugcaaaaguaaauuaaacaaaacccaaauaaauaaagaaauaaaccagguucacggauugaaagacucaguagcguuaagacugcaguucucucucggccuuagcgccauuuuuuuggaaaccucggcgccaugagagccaaguggaggaagaagcgaaugcgcaggcugaagcgcaaaagaagaaagaugaggcagagguccaaguaaaccgcuagcuuguugcaccguggaggccacaggagcagaaacauggaaugccagacgcuggggaugcugguacaaguugugggacugcaugcuacugucuagagcuugucucaauggaucuagaacuucaucgcccucugaucgccgaucaccucugagacccaccuugcucaaaaacaaaaugcccauguugguccucugcccuggaccugugacauucuggacuauuucuguguuuauuuguggccgaguguaacaaccauauaauaaaucaccucuuccgcuguuuuagcugaggaauuaaaucaaaaaaaaaaaaaaaaaaagacugcaguucucuccuauagauucaauuaaaucugaccuauagauucaauaaaaucccaaucaaaacuauaguuuuaaaaaaguugacaagcugaauuaaaauguauaugaaaaggcaaagaaccuagccaaaauaacuucuuuaaaaaaagaacacacuggaagaauucuaccuauuuucaaaauuuacuauagagcuauacucaucaaggcaaugugguauuggcauaagaacggacauauauacauuuaugaaacagaagugagaguauggaaauagauacagacuuauaaagacaauugcuuuuggcaaagguaccaaagcaauucaauggggaaaagacacucuuuucaaaauaaaugacaauggaauuagacaucugaaggaacaaaaugaaccuugacccugaccucacaccaugcacaaaaauaaccugaaauggaucauagacuaagagcugaaacuauugaacuuauggaagaaaacaugagaaaauauuuugauacuguguuuggcaggacacaaaacucaggaaccacagaaaaaaaacugauaaaaugaacuucaucaaaauaaaaaacuuaugcuuuuuuuuuuuuuuuuuuuuuuuuuuuucagacacucugucacccagguuggagugcagugaugugaucuuggcucacugcaacccaugccuccuggguucaagcaauucuccugccucagccucccgaguagcugggauuacugacgugugccaccaugcccggcuaaguuuuuguauuuuuaguagagauguuagccacuguguuagccaggauggccucaaucuccugaccuugugagccgcccgccuugaccucccaaaguggugggauuacaggcguaaaacuucugcuuuucuaaagccacaguuaagacaaaaaaacaaagcacagacugggacaaaaguuugcaaaacguauuuaacaauguuguaaccagaacauauaaagcacucuuauagcucaauuauaaacaaaauaacccaauuugaaaauggguaaaagauuucaauagacacaucacaaaagaaaauauguaagugacacaugaaaagauccauuacuagucaucggagaaaugaaaauuaaaacgauauaguacuacacacccacuagaaugaaagaagucugacagcacuaaguguuggugauaauauggaacacugcuggaggcaauccaagaugguguagccacucugaaaaaguuuggcaguuucuuauaaaguugaacauauacuuaccauaugacccagcacucucacuccuauuauuuguucaagauaaaggaaaacauaugcucgcacaguuuuguaugugaauauucauagcaacauuauuuauaauagcuaaaaauuagaaacaaccuaaacuuccauaacagaucagucuaaguuuugauauauccauacuacagaauacuguucagcaauaaaaaggaaaaagguaggccagguguggugacucaugccuguaaucccagcacuuuugggaagccaagguggguggaucacuugagguccggaguucgagaccagccuggccaacaugaugaaacuccgucucaacuguaaauacaaaaauuagcugggcaugguggcaagugccuguaaucccaguuacucaagaggcugaggcaggagaaucaccugaacucaggagguagagguugcagugagccaagaucaugccacuguacuccaguaagggaacagagugagacuccaucucaaaaaaaaaaaaagggagaaguauaugcaacaucauggaugaaucucaaaaauauuauguaaaagacauacgcaaaagacuacacgcuaugugauucuauuuauauaaaauucuuggccguggcucacaccuguaaucccagcacuuugggaggcugaggguggauccccugaggucaggaguucgagaccagccuggccaacauggugauaccccaucucuacuaaaaauacaaaaaauuagcugggugugguggugggcgccuguaauccuagcuacuuugaaggcugaggcaggagucugaaccagggaggcagagguuguagugaacugagaucgcaccacugcacuccauccugggcaacaagagugaaacucugucucaaaauagauagauaaauaaaaauucuagaaaaggcaaaacuacaguuacagaaaagcagaucaaugacugccugggguugggcugagaagaagacagauuacaaaggagaacaaggaagcuuuauaaaagugaugaaaauguucuauauugugauuauggugguaguuauacaucuguauguaauuacaaaaauucaucaaacuguacacuuaaaauggauaaauuuuauugcauguaaauucagcucaauaaagcugggggaaaaugcaaaaauaugaauaaaguuacuuacaggucucgcuuauuaaagcagaacagcacucccagaagaguugucaauaggaaugcuaagcaaacaggcacgacuauggcuucaauuucuccuugagcuuaaaaaaaaaaaaaaaaaaaaaaaaagaggugugaugggaaauaauguugacauaugaacuaagaagacauaauacaacuucccaaccagacuuacuguugaaaagauaaaauacaauccuaauuauuuuucaaggucucuucagacuugaugauuuuuacccucuucucucuuugguaaaucacaucccaaccauuuaugucuuauacauuaaccuggccgcauagcauaaaauauauguugguugggggauaaaaaugaucaguguaucggguaaucuacuggguuagagcuuucaaacauaaccauuuguaacauuuaugaucugcauuugguagaaucuuaguaaaaguuuaucucugaguucuaauacuguauaacagagaaauuaugucagaacaaauauaaauacuggguaaaauggaaaagcuauaaaaacauaauugaacuacacauuuaaccuucuaaaaaauaaaaaugcaacucucagaaguuuuaagaguuauuuaccauuuuucaaaaggaggauauagcugguacagggcuaagaacuuuaggagcugcucaaugggcaugaggaguggcacgaguaggaauaaacuaaaaaguaaacaagccuaagaucccuaaauaccacacaaauccucaucugcauuuaaaagaggacuuguucaucaaauuaaucacuaauugggauaauuaacauuggagauuuuuuaaaugacuguccugauuaauuuugaauuuuacuuagucuuuuacaguaaaaaauguaugaaaguaauauugcagccauauacuauucacuuaauuuuauccuuccaccacacauaucccuuuguaaguaacuaacauccuaugaagcucaguagaaaucaagaaaucaguuaaaugcuugagaauaaacuauggguuggcaaauauuaacucuuaaaugcuaagcaucauauauauauauauauggguguauguauauauauuuauguguguauauauugauauauguguguauauauauauugauauggguauguauguguguauauauauauaaaaugccaaaucuaauuuaggcagaaacuuugcuuuauuaaacaucugcuuuuauguuuucaagccugugccuuugcucaugcugcucucuaagaugccaccuucuuccuauuuguccacauacuaacucaaggcucaaguauuuucuucuucauaaaaccuuugaagguaaaauuauccacuacugguauauuuaaauuccuacucuauuuacugucuacauaguccacagguucuccuuuuucugauuuacuuaugcaaaauuucuucaacuaagcuguaagguccucguuggcaagacucaagccaugugaagaagccauaauggauccaugagacuacagauagagaauugaaaaaagguagguuauaaaauaauacuaaguauaauuuaauuuuaggaaaaaaauauauacaaagaagacacuaaaaggauacacaaauauguuauuuugggguaagggacuaggacuaauuuuucuuccucucuacauuuuacuguacagucuaaauucccuauaaugaacaccuauguaauaaaaaaauuuuaggcugagcaugguggcucauaccuguaauccggcacucugggaggcuaaggcaggaggacugaggccaggaguucaaaaccagccugggcaacacagcgagaucccaucucuaccaaaaaaauuguuuuaacuagccaggcaugguggugccuaccagcagucuuaguuacuugggaggcugaggcaggaggauugcuugagcccaggaauuugagguugcagugagcuaugacugcaccacugcacuccagccugggagacagagcaagacucugucucaaaaacaaacaaacaaaaaauauacauaugggcuuuuauguguguguguacacacacacauacauauauacaaagcucuguagagauggcuggucuccacagaaauacauaaaauauacauuuuuaaguuuauuuuuuaauuuuucucaagauuaugguauaaaguuuuauuuuaaauaacauaccuauuaacauaccaccacaugggaccaaccuuaucccagaaacuauauucauuacugacccuaacagcaaagcucaggaacuuuuaucauuuauuuuauguagucacucauucauuuauucccucauucagcaagcauucaaccaacaaggcacauggaauuuacuacuuaucauuaacuaggcuggcacuuggggguggggguuacaauuaugguaaaauaagguaauuuucuauaaugauucaaaauguagggggagcaagaaagaauguugguuaaguuugcuuuagggaagauacagaagagccagaugaugaggugaagaccucacugggggcaaugcacuaagaaaagagaaguuagcaugaggagcuugcaguugaagaaaaugaugaugaaaggguacgcacaaucaacaggacuugacacucagcuuaugugagagaaaaauauacaaauacauuuauuguaaucacauuuaaauuuauggcuuuggcauagaacgagggagggaaaauguauuugggaaggaaagagaagauggcuaaagccauggacagaguuugaauaggcaaguaagaaaacagggucaagaggccgggugcgguggcucaugccuguaaucccagcacuuugggaggccgaggcagguggaucaccugaggucaggaggucgagaccaucccagccaacauggugaaaccccgucucuacaaaaauacaaaaaauuagccaggcaugguagugggcaccucuaccccagcuacgugggaggcugagguaggagaaucacuugaaccugggagguggagguugcagugagcugagaucgcaccacugcacuccagccugggugacagagcgagacucugucucaaaaaaaaaaaaaaaaaaaaaaaaagcaaaaaaaggagaagaagaagaaaacaccaaagaacaaggagacucaggagacugugcuagcagaaaaaguaugguuagaaaacccaagggaggagggaguuucaaggauggaaggccaacagagucaaaugcagaaaaggcuggaggcaguggcuuaugucuauaaucccagcacuuuaggaggccaaggcagaaggaucacuugagcccaggaguuugagaccagccaucucuauaaaaaaaauuagcuggaugugguggcacuggucccagcuacuugagaaacugagguaggaggaucacuugagcccaggaggucaaggcugcagugugccauguucaugccauugcacuccacuguagccugggcaacagaguaagacccugccuccaaaaaaaaaaaguagaaaaaagaugaaaacuaaaaagcaugcaguacauaugaugaucaagaggucuucugagugacaccagagagguuucagugcaggggugggguaggaccccuaauuucaguauguuaaauacugagugggagguacggaagugaagacuguaaaguggacuaguccuucaaguaaucucucaauaaaagaaagaaaugaggauagagaaggaaagaacacacccaaaccagugaaaaaaaugaacccacauggaaagauacacaaauucuuuuaggauuuuuaguacagcugaauauagucagaagcaguuaauaaaauaccaaaaaggugaggaauaacacuuucuauaaagaaaccaccaaccaaagccagauaauauaaaaaucaucaugaauccaaagauguacuuuuuaacacaauuuuagcacauaaacuaaguucauuucuaaccuaaguuugagaaagaaaaaaaaccaaacuucauuauuucuuaccaaacuuugggguaguaaaagugaauucuggaccauccuucccaccuucaucuguguaugcugccauucguaccauguacaaugugucacuagucaaagaggacaauguauauucugugugggaagaauccacauucacagcuggaagaaauaagaacugugcuucauucaacuauucaaugcuuuugcuuauuuggccuauauuuggcauugugaaaguguuaaaaaagaagcgaaguauuuuuguuggaaaacaacuuuuauaauguucugacauaauuuuauguucuaaagcacaacacaauacuuuuucaauaaauccaugaaaguaaccauaaggcaaauucucaggugucuccugaggccaauauacuauaagauguauaagaagaacagacuuaaauuaguacuuaaaagcuuaaggaaaaaauaacugauucuuaauaacugauacaguuuuauuaccaguuucauuuccaaugaugguucuauaaaauauaguauaauuucugauaaauccauucugaacaucaacaggaaguuggucccacucuaagacagcuucguuuuucccuacuuuuuuuguccgaacaguagguccuuuggaaggugcuguaacagagugaacacauuugcuaacugaaaaucauuuacaaucuaguaaaauuuccuugucauaaaaucauuugaacauaaugagauacaucuuuauuuaaaagcgauaaaauguuucuguuaauacaaagcccuaaacuuuuuuuuucaaagaagugaguuuggacuuacgagcuuguuuaagguaugccuuuauggauucagggcuuccugguccaucagcauauacuggaguaacuguuaucaaauagcauuugcucucugcuaaguucccuaaagcaagaauagcagauuaagcauguuuuuccauaaugaaaaagucaaguuaauaccguaauuuauuuuuacauuauaauuucaugaccacuuaauuuucuuuuaaaacugcaguuuucuaaguaagcauugucuuuuguguacuggauucaagcuuaaucagguaaaacugucuguaaaaguauugccaaugcaguggauaaaaaauacauuguuaagaacaaugaugguauuuacauuuagaauuuauaaaacaaugaucucaaauuacucuggauuuuauagagucugacaauuuuuguaugucuuaccuacaagagagaacagccuaaggagcaagacgacuaaagcaguaagaccuaggggaaagcacuaacgguccuaguuugcgaguuggaaaaaaggguaucuuaaaaaauuuccucggccaggcgcuguggcucacgucuguaaucccagcacuuugggagguuaaggugggaggaucacuugagguuaggaguuugagaccagcauggccaacauggugaaaccccccuuuacugaaaauacaaaaauuagcugggcaugguggugggcaccuguagucccagaugcuugggaggcuguggcaggagaaucacuugaacccaggaggcggagcuugcagugagccgagaucgcaccacugcacuccagccugggcgacagagugagacucugucucaaaaaaacaaaaaccaaaacaaacuuccuuuauuuuuaucuuuuuuagcaugcaccacuaaaauuuuucuuauuuauacaguauauuaucuguacauauuagaaaauguuuuauugaaauuuauaccuucaauaagaauguauauuccuuaacuauuacucaugaaguuacaugcuccuuuaccuucuuaaacagauuuuaccuuuucuuaaugauucaauauuaccaaaaaaugaacaauuuuuauauucuacucuaaugugaugcuuucaggguuacugagcaacauacgacuaccuacccaaacuuaaugucuccacaacuuaugcuagcuucuauuuuuuuugagauggaguuucguucuuguuguucaggcuggagugcaauggcaugaucuuggcucacugcaaccuccgccucccggguucaagagauucuccagccucagccucccaaauggcugggauuacaggcaugugccaccacgccuagcugauuuuguuuuaguagagacggaguuuauccacauuggucaggcuggucucgaacucccgaccucaggugauuugcccgccucagccucccaaagugcuggaauuacaggcgugagccaccgcaucggcugcugcuuuaaaaaguuucuauuggcucugagcagugguucacgccuguaauaccagcacuuugggaguuugagguaaaagaaucgcuugaggccagguguuggagaucagccuuugcaacacagugagauucccucucuacaaaaaaauaaaauuagcugaguguggcagcaugugccuguagucccagauacuccagaggaugaggcagaagggucacuucagccugggaguugaaggcugcagucagccaugaucaugccaccauacucuagccuaggcaacagagugagacccuguauuuauuuuuuuuuaagaaguuucuauaguuauuuccagccuguuucaggacuuccuaagcuccaccauguuuuuaauuugauaaagucaguaaacuagauaaccaagcuuauuaaaacuguacacuaauaacauguaaguccaaacagccuguauuaugacuaaagcucaaaaacuuuauggcaggaaucucucugcuuagggcuuuucucuaauuaaccauauuauucacagcugaauucuaauuauuaauuaucaacaaaagacuauaaacugaguuuuuuucucuucaaaguuguuguaucacuuuauaaccacuuaagcagcaccauaacacacagacuggagcgcuacgauucauuacuucuguccuuuguuacuacuuccaauugaaagacauaaggaaaucugaguucuaguucugcuuccucuaucugaugguucuaagacauuacacaagucauccagaugcucuaggaaacuauuuucucaugugaaggaugagguacagagaacauauaacuaaucagcagcaaagguuggacucuuauauuucucuauacucuauaguuuuaggaguuuucccuugacgauaaaaucauauugggguacaaaaagaagaaaguauuaaccccacucuguucauaaagagacuguaauucagagagguuaaguaugacuugcugaaagucacacaucuaguaaguagugaggcuaugauaaauuggaagucguuucaacggaccaaaacacuauaagcaaaagaaaaagcugccuaaagaguuagaaaaaggauaucaauuuagauguuucuagccagguauaccucuuaaauaggugcgaugcacgguaccaucuucuuguugccagucugugauacagggugcuuuaucugauaacacacaccacucaaguauauauuucuuuacagauucccuuggaguaguccauuccacccaaagcauguuaucuuuggggaaugcuuuaagauccauuacagggugaguagcuuuaaaacaaaguuugaauauugaaauaauaaauauuaacaaauuugaaauuuccauauuuuacagucauuuccaaaacaugugauuuaucaauuuuuguagcauauacuuccuugccuaaaagcacuuuauuauaacuuacagguaaaguagucaauuuuuaaacuuagauuuugcuuccccgcugggcacuguggcucauuccuguaauuccaacauuuuacgaggccaaggcagguggaucacuugacaucaggaguucgaaaccagccuggccaacacggugaaaccccgucucuacuaaaaauacaaaauuagccaggcauuguggugcgugccuuuaauuccagcuacuugggaggcuggugcacaagaaucgcuugaagccaggaggcagaggcugagaucgugccauugcacuccagccuaggcgacagagcaagacugucucaaaaagaaaaaaaaaaauuugcuuucccuaaauucuucaaaugcuuucgguuuguaauugcaauuuuucuucuuugaaagcuacgaauaaagcuacagauaaacguuucagucauauguauacaaaguucucaaaaucuugaaauaauauuuuaaaaaccagguaaguaaucagaauaugcuuaaaugaaugaaguagcuuacugugaaguuuaagugagcauguagugauggaaauguucuugcauccugaugaaauuugucugcugacugauuccuaaaaaugcgaucacuagcuggguuugguggcauaugccuguuaaucccagcacuuugggaggccaggggagaucgcuugagcucaggaguucgagaccagccugagcaaccuggcgagacccagucucugaaaaaaagaaaaucauuauuuauaaaauuuaaaaaauuaaaaaauaaacaagugauuaucccugauacugaggagacagucuuagauaacuuguguuuuuuaugggagcccuguccauaccuaaccaccauuuuuccacccaagagucaggcuccaucucacagauacaaaccuugaaagucacaggcagggauaguuaaaacagcugcaucugauuugccaacaagauuucuuacuguuaggguugcuagauagcgaucauuugugagauuuacugucaguuuuguggcauuaacuguguaauuuuguaaaugugauuuccaucuugugagagucacuucauaauccaagauuuuuccauuggcuucaaaaggaggcaaugucuguaauaaaauaguuuauuuuuaaaaauaaucucauaaaucuugaauaaaaaaucaguuuuucuucauauucacaaaucaugccauuaugucaaaucucuaaauauuuaacuggaaaggauucacaaucuccauuuuaaauuugguucuaaaauaaaacuaguacauacuaaaugaagaguaaaagcaugaccucaacuaaaaaaggguaaguagcaucauuccguuagcuuuugguucuguaucaauucugcacuguggcuauguaggucuaaauuauuuauuuuaugcuugaguauuuuucuaccuucuuuuuuaguaugaucuacucaugcacuuaccagcauacauuuugauuaucacaaacuuuuauuauuuucugaguuacucuggaaaauuccaaaguacaaaaacaacauuccucuucuuauagaacuuauacuuucacagaacuguacuuaaauaccuauaagguauuauuuguaguuuaugaaccugacuucuauauaauauuaauacauauaaagcauuaccuuucuauuuaguaaaaauaguaaucaaaugcuuugcuauuaaaaugaauaaaaauuuaucuauuuaaaagaccuccauucauaauaccauacaaaauguauuuauaagggcugggcgcgguggcucaugccuguaaucccaguacuuugggaggccgaggcaggcagaacaugaggucaagagaucaagaucauccuggccaccguggugaaacccugucucugcuaaaaauacaaaaauuagcggggcgugguggcgcacaccuguagucccagcuacucaggaggcugaggcaggagaaucacuugaaccugggaggcagagguugcagugagccaagaucacgccacuacacuccugccuggcaauggagcgagacucgguuucaaaaaaaaaaaaaaagauuuauaagagauaaaauauaaaugugauuuuuuaccuuccacacgaguuguacaguucuguagccuugaguaugggauggaucuauuuuauaccagaaacuuggugcuuuagaugguccuaaagaaaagacauaaacuccuuaaaauaaaaagguuuuaacaguaaaauaaaauucugcaaauuauucuuuuacuuuguucuuaauacucuugcccuccaauugcauggugucucuaccucuuuauaccagcauuuucccaacccagcacaaaacaccuggcucuuccuuuagucagggugauagccugaucaauuauacuggaacucuuuucuaaccucaaaauuguaaagguaaaaauguauucugagcaacaacuaaagaggcaucacucuuucuuauaacuucauguucuuuauucuguuugugugcuggcacuguauuuaucuacuugaaucuccuguaccagcagccuuuucccagccuuccuggucugccuguccucacuucuguuuugucaucuguaauugccucuucaugaucaacacaucacugcuuagauuuuauucaacuccucucuuauucuauuaaauaccaggucuucuaauuauauuuauaaaaauuuugaaaaauuaguuaauaugauuuuuuaaagaaaaaaacuuuuuaaaauaaaguuuuuaacaguaaaaaauaaaaaugaaauaaacauaaguugauacuacuuaucgcugaaaaucaaacuggaaaaucuauuuaaacacauugcuuacuccuaaauauucacaagaauaauaaaacaaauuaagauaaauguacuaaaauaaguuuauuacuuuauauaaggaugauugagagugaugggauguaauaaaaacaaauucacaguauuguugugauaaucacuaaccaucugaaaaagcaauccauaaaacauagugguuuuuuuccagagacagugucucgcucuguugcccaggcuggagugcaguggaugacuauagugcacuauaaccuucagcuccuaggcucaggugauccucccaccucagcaacccaaguagcugggguuuggccaccauacccagccaaaacauaaauuguuaaauaccaguaauuaaauucgguuuuaaaaauaccuguaguauuaauuuuucaaaacuuauaauagccauuaaauguagcauauaauuuuuaauuuuuuagcaauaaguaauaucaacugacauuucauuuuuacuuaucauuguuaagcuuuuuguaaaaaguuugucuuaaaaaaaucaauggcauuaacugauuucucaaaauuuuuaugaauauaauaacaagauaugguagucaguagaauaagacaggaguugaauaaaaucuaagcaguaaggcugggugugguggcucgugccugcgaucccagcacuuugggaggccgagggaugugguucacuucaguucaguaguucaagaccagccugggcaccaugacaaaaccuugucuccacaaaaaaauacaaaaauuugcugggcauggugacacgugccuauagucccagcuauguugggggcugaggcaugaggaucgcuucagccuuggagguagaggcugcagcgagccguguucaugccacugcacuccagccugggcaauagagugaggcacuauuuccaaaaaaaaaaaaaaaaaaauuuaaguacugauauguuaaucaugaagaggcaauuacagacagcaaaacagaaaggauaggacaggcagaccaggaaggcugggaaaaaggcugcugguacagaaguuaaaauagauaaauucacaugaguacagugcagcacucaaacagaauaaagaacaugaaauuauuaaaaaaaaauuaugagcuggaaauauuuccuaacauaaagggaacccagagacuucauucacgcauugauuugacaaagauuauguacacuuguccauuaaaaaugcacacaggcacuaaccacaauauuuuaccuacauuuuaaacuauuucaugaacuccuccccauguaucucauuuuaagaauuccuggucaagacaaagcaaucuggcugaggacucccacagcagcaauagcaaaauugauuucuuucucagcauuuaugagagaaaucuuagggcagaaggguacuuuucugccuuugauguucucaagucacaugaccuaaaccucuagaagagcuggaaguaaagggauauaggugguaggggauuuuuucagccacagcuacugccauugauaacuaagagaugagucugugauaggaaggucucaaaaugaaaaaucuaugccacgggauuauuucuugaacuuaguaacaucagaugcuuugcagugaggaucuuacuuuagacuguacacucuuuuugugccuuuuuuauucuauaucauauauauuaucuauaggagaaaaaaggaaaauaaaaacuaaccaaccaaaauuccaggaucaaccgcuucccaggggcuuaucaagugcuauuagaaaaaaaaugaauaaaagguauaauacaaguauauuuuugauaguggggaucuaagguguaguuugcuagacagugugguuuuaaugauucaggauaugauucucuaguuaggaguaucucuggacaagucuccuugaauaaaauguucuagacuuaucaacaguuaacgguuuucugauagauguaucuaagucaccauuccaugaugaauuuuuuuuuuuuuugagacggagucucguucugucacccaggcugaagugcaguggcgugaccuuggcucacugcaaccuccaccuccuggguucaagcgauucuccugccucagccucccgaguagcugggacuacaggcgcccaccaccacgcccggcuaauuuuuguauuuuuaauagagaagggguuucaccauauuggccaggcuggucucaaacuccugaccuugugauccgcccaccucggccucccaaaguacugggauuacaggugugagccaccgcaucuggccuccaugauaauuuaauuagguaucaaauagacuuauacuaucaaugauccauauucaauuuuacaucuuaauguccuuaaaaauuaaaacguuaaaauacugcaguuugaauaaaaugaucacaaacuaagaagcaaugaggcuauauuauuaaaaccagaaccaguucacaucuggaauuccaauagcuuuacuucuucauauacuuauguacuuacuaucuucauaggugaucccacuugcuucuucacuccagucacuccaguaucccuuaccaucuuccuucauacagcgaauccuaaacacauauucuguaaaagguuuaaggucuuggacagugaaugaagaucggguggaugcugugucuucaggaggaaucugaaacaaagcaaaccaaacaacagaaaaccucaauuaguaaggucuucuaaauuguguuaaaauucagaaacuuuuuuuuuugaggcacagccuugcucuguugcccagguuggagugcaguggugcgaucuuggcucaacacaaccucuaccucucccagguucaagcgauucuccugccucagccuccugaguggcugggauuacaggugcccgccaccacucucagcuaauuucuguacuuuuuuaguaucaacaagauucaccauguuggccgggcuggucuguaacuccugaccucaagcaauccacuugccucggccucccaaagugccaggauuacagaugugagccacugcgcucagccuagaaacuauuuauuuuugagacagagucucccucugucgcccaggcuggagcucaauggugcaauggcgcgaucucagcucacugcaaccuccgccucccagguucaagugauucuauugccucagccucuugaaacuauuuuauugacacaagacuaauacauuaaacucaaccucuggagagaaauaaguguaaguuaaaaagcaguccaaaucaguaaaguuauuugguuuuagaaguauggaaacaucuauuaucuuuccuuuuuucccuuuauuucuuccacagggccuguaauauaacuuaggauuucugcaggaaacagauggcacacuccauuuagaauaauucaaggagggcuucauaaagggacuacaugcagaguauauggaauccuuagacagugcaguuaguacucuggggcuuagagcuguuucuaccucuaggcccaaagggaugaggggaaguaccagaaccugaaagaagccggucagcuagagagggcugucuugacagguagugacccuaaguugaaagacagccggcugggugcgguggcucacgcuuguaaucccagcacuuugggagacugaaguagguggaucaccugaggucuggaguucgagaccaaccuggccaacauggugaaaccccaucucuacuaaaaacacaaaaauuagcugggcaugguggcacacaccuguaaucccagcuacucgggagucugaggcagaagaaucgcuugaacuagggagguggaaguugcaguaagccaagaucaugccauuacacuccagccugggcaacaagagcuaaacuccaucucaaaaaaaaaaaaaaagacagccaguuccuggaaggaagcagggaaaaucaacaugccaauuucacuuuucuucugucuucucuccugccuagucccuuccuuccauuaaccacagucacaaggaagcuagaaagaauggaaacccacagaugaaaucuauacaggucagcaugacacaacaaagagaaggguagagcguagauguggacaggcaaaaggaagauauccagcccaaucaagaaaaacaaaaguuuuccuggcuuuuaaacuuggcuuucagaaaaaaagaggagauuaaauacagauaaauaacuggucauauuacucugauaauuuaguauuagauacaaaauaaacaucagucuuuuuuguagcacugaauuaagauucuauacuuaauaccacauuuugaagaacuucagguauguauauucucuguacaacaugaagcauuaauccaauuuuguuuuauugcuuuuucugauuguauucugagcacuuuagauaagugggguaaggagagaaguaguaaagucauuagcccaauucccuaacaagcucacugugaccagagcaacaaaagcaaagacauacuguuugugauaaauggaaucaaaacagagaagaguauggauagcugaaugcuauggugauagccuuuuuaaaagcuccaaguauuucuuuugcugguagcaucaucuuuggguauacuaucauuuucagucuuacaagcucccuaucaaucccuuccucuaccucagugguuggcaaacuuucuauaaaaagguagauaaaauauuuacuaauauuuuaggcuugugggccagagacucuuuuugcaacuacucaacucuuccacuguagaauagagacaauauguaaagaaaugaguguggcuguguuccaguaaaacuuuauuuacaaaaacaagucacaggcugauuuugguggacugcagcacaccaaucccuacacuagcuaccuuauccuuauaaucucuuuauuuuugcuccucuacuuaauuugcuuuauuacuuguauucuuuguaacacccaucaaaaaugccauuucuaggcugguagugguagcucacaucuguaaucccagcauuuugggaggccaagguaggagaaucgcuuaaggccaggaguuugagaccauccugggcaacacggcgagacuccaucuccacaaaaaauaauaauaauuuuaaaaagccaggugugguggugcacaccuguagugagacuaaggcaggaggaucacuuaagcucgaguucaaaauugcagugagccagcggccugggcaaauggagacccugucucuagaagaaaaaaaaaaaaaagccauuuccuaucacccuauaucauuuucauguuuuacuuaaaggcuacuguauuuagcaaagcuguauuuucuaucuggauaucuuccugauuccccuuguuugaaauaacaacccagaagagguuaucaagcaaaauauuucacauaaccagaaacuuaaagacauuuagaaaaugacugaaacuuuuuaagauuagaggguugaaagaaggacuauuugaauaaacgguaacuuucaauuuaccuggcuccaaguugaggcaucuuugguccuauauugaauguuauauuuuaguauuauaacacucuuaauacuuggguugguccaugucaauuuuaagauacuagacaguuccucugaguugaucacugauaaauuauguggcggauugggcuucacugaaaaauaaaauaaauccuaagguuuauuauguuuuccaauuucauauacaaacucaaauauacucuuuauauuguccuuccuuuauuuuacaauaauuuauccuuaccaaaugaacuaauuucucugaaaauuaugcuaugcuauauaccuuauaauggaaaaaaaaagauuucuaaagaaucuucaguucuccuuguuaauuuacauuuguuaaucucuucagguucauaugucaaaagacaaauauuuaugauaucaaauuuuuaaaaaagaauaaaaauggaacauacauacuguaauuacaaugguguaagauguuugagaacagaaaacauucaaagugaaaacagcuguuaagugugguuggauuauggauauuuuucuuuuuccaaauucuauuugauauuauugauaaaaugacuucauaaaaaucacuaagauaaaugcuuguuucuacauuaauuaaaaucuaaaaucuacauuaauuaaaaucuaaaaaaguaaaaucuaaaaacuacauuaauuaaaaucuaaaaaucuacauuaaaaucuuaaaaaaucuaaauauaaaaacuacuuuaauuuguaaacgacuacagugucaaauaaacucucaaauucagguuuauaacuaccuuuauauacaggaucaaaauugauaugaucugauguaaccuucccaagggcauucucugcuucuacccagacuucaauguugacaaaauacacaguagaauaaucaacagugcaugaggugggggugucacguuuugcuuugcaaucagcaaacuuguguguugcccuaaauacaaaaaauugaagaaucagucauuaaaaacacaucugaaaaaauuagagugaaaaaaauuacuugcaaagaguuugaugagaccuagauuguuguagcaaacuuugcaauauaacugcuggucacuaacaaaauuucuuaaaaauaaaccuuucuuuaaaauuaacuuugaucuauaucuuaaaacauaaaauuauuuucaaauuuguagucuaaaaauauugugcuuuaaaauuuuaugcuccauccccacuuacuccucuccaaaaauuaucuauuuccuugugaucccagugcuguuuuuucuuuuuccuaaaacagaacccuuacuguaccacaaauuucuuuaagcacaauaugcuagaaggugacaggagguuagggguaagaauuucuauuaccccuuagccuuuagucuuagggcuaaaaucucuuagccucuuucuagucaaacuuaggcaacuacuuucugauuucuaucaccauggaaaguuucaaguaauauuacuauauuuauuuacaauuauauaaauuaugccucaauuaaaaauauucauauacaacacuguuuuuaaaaauaggauaaaccaaaccccaaauugaaccaaaacaaaaaugguuagccucuaaggagaaggaaauaagguagaggauucaggaauagaauauagacuuuucugaacaagccuuaauacuauuaauagauuugacuuuuuggauuguuuuauauaauuauuaagaaaaauuccuaaaaauuaaaagcaaaaugaaacauaugaacuuguguacugaguauguaguauaaccacauagaaaagaacuauuccaaguaacauuaaaacacaguaaucugacuauuacacauccuucacagagaaaaacaaucuuaaaaucauucuugguaaucauuuuguuggugcuaauacuguuguuauuauucugcagcugcuguauuaaccguaggauaaagcaaaugaauaauuauguuaguguuguugucaacuauguuuuucaguucauaagaaagaagauguagacgucagguaaauauaauuauguaaaaaccuauagcccuaauuuuaaacugaaaauaucaguaugaauuuguauuuuuaaaagauaguauuauaucucaaaccacaaaacauguccuagcucuuucgacugaaaaaaucuaaaaaaucuaaaaacuaugacaaaccaguagugaugaauuccuguagcacccagauuguagucuguaaauauuauuucacacuaaaugaaaccagagaguuuugggaaaagguugauuccaggucugggugaggaaauacaugaugacccuguaaaagcauguuauaucagagagcuaucaaaggcuaaggaaguugugucaagacgaugaaugagccgggcgggguggugggugccuauaaucccagccacucgggaggcagugagccgagaucacgccacuucacuacagccuggucaaaagagcaaaacucugucucaaaaaaaaaaaaaaaaaaggaugaaugagccaauuugaguaaacugccacugaucaaagaugggacaauccauaaugaguuaaaacauaucaaauauguuuaaauauaaauuuauaaugagaaagaaaagcccucauuauucuaccuuuggaggauacuagggaaucaacuaauuauaaaacugguaauuaaggaaaaauauuaaaccuaucuugcuucuccuaucugaacuguacuucaggguaaaccacaguugauaaaggcaaguuuuucuuuaaguauuucagcuaaaacaaaacacagaauaccauaguuuuguaauuuauauacaaauuauaaucacugaugacugcucaaagcuguaagggaaauacuagugggaaaacaacaugauuaaauuucggaaacauucuguugaguuauaaaacuuuucacagaagaguauauacuauauaaucccauuuauaugagacauucuguaacaggaaaaaauaaucuauggugaagaauaucagacagguaguugcucaugggguggggcacuugcugggauugacugaaggagcaggaaggaacuuuuuagguguguuagucauguucuaugucuugauacugauugaguuacacaggugucuguacuugucaaaacucacugaaugauacacuaagauuuguguuuucacuauauguaaauuuuauuuaaaaacauaauacugaacucuaguucauguaaauacugaagugauuaagaaugagguauauuaaugacuguaacucacuaugaaauacugaagugauuaagggugagguauauuaaugacugcaacucacuaugaaauacauaaaaaagagauagauugagagauggagagaaggaugcauagauaaauaggugauaaagcaaagauaguaaaauguuaauuguagaaucuaggguaugcaagaguguucacuguaaaacucuuucaacuuuucuguuuggaaaaaacaaaugggaaacuuaguaaauaaaggaauaaggcugacaacacccgaaaccacugcucaaucuuaguaucagaaaaaagaaaaacagugaaacauuaucuggucuuuccugacagaaguacacaucacuccuacaaaauauuuuuuuggggaaaaaaaaaaaaucaaacccaaaucugaugaaaucuguagaucuaaaagcaauuuuuuggaaagaaaaagacaagggggccaggcgcgguggccacgucuaucaucuaagcacucugggaggcagaggcagccagaucacgaggucaggaguucaagaccagccugaccaacauggugaaacccucucuauuaaaaauagaaaaaaauuagcugggcaugguggcacaugccuguaaucccagcuacucaggaggcugaggcaggagaauugcuugaaccugggaagcggagguugcagugagcagagaucaugccacuguacuccagccuaggugacagagcaagacuccaucucaaaaaaaaaaaaaaaaaaaaaaaaaaaaaaaaaaagacaagggaauauguuaaacaauguacaauguauaacaguuuaacaacugaaauguaagaaaaaagaacaaauagaaccuauaauuuaagagacaagacauaaauucacaaaguauggagcuuauucgaaucuugacugaaacaaauguaaaaaaaauuauacauauaggcauauucaugagacauaggggaaaucaacacuaacugaaaauguaauauuuuauaucugaguguaacagugguauguuguuaugcuuuuuuuuaaaauguccucaucuuuuagagacgcauacugaaauaucuuuggaugaaauaugaugcccgcgauucucucuucaagacaauauaggcaaagaguaccuuugaaauaagacuggucaugagcugaccaguguugaagcugagugauggguauguauggguauucuacuauucuuucuacuuuuauuuuuuauuuauuuauuuuuuuugagauggagucucacucuguuacccaggcuggaguguaguggugcaauccgggcucacugcaaccuccgccuccuggauuuaagugauucuccugccucaaccuccgagucacugggauuacaggcacccgccaccaugccuggcuaauuuuuguaguuuugguagagacaggguuuugcucugguuggccaggcuggucucgaacuccugaccucaaguuaucugcccaccucagccuccguaagugcuggaguuacaggcaugggccgccgcgccugggggauuacaggcaugagccaccgcgccuggccucuacuuuuacauauauuugaaauguuacagaauaaaaaauuaaauguuuuaaaauagcauuuaauauuauuacuugguaaaauaaaaauuccagcaaaaaugacuaacuuuaauaaaucuaacaugaaacaaauuuaaaauaacguaccauucagauuuuaaagugaaguuugucuccaaguguguuucccuuccaccaucccacucacaccucauuuucuuccccucguucacaaugcaacucaaauuuuuagguuuuucuggaggcacuaaaagggauuaauuagcaucuuucagaaagcuuuauauccacaaauauuaugcaauuuauauacuacccaaggcauuugcgaucuaaauuagaugaaaaaaaucaaacccaagcaaaaaguauggacacaaugaaaggcugaugacaauuucuuuucuaucccaacucuuacacuucuuuucaggaaguaauauauauacauccauccuaacugucaucaacugguuuguuucacauuaauuuucuauguaaaaucaacuuucauuuauaacuggaaaaaaauaucaacugauuucuccauuaaguauauuuuuaaaaguaauauauacauauguuuguaagaggcaacuaaguagaagccaaaaugauucauuuauauuucucuucuuauugcuuucccaaacucguuggaagaaaagcaaaugccaaaacaguaaagucugggugauccacaaauuagauaacccacuuuuggaucauaguaaguuuauuuuguuuacuuuguuacuccaaggccaggcacaguggcucacgccuguaaucccagcaguuugggagcccgaggcaaguggaucaccugaggucaggaguuugagaccagccuggccaacauggcgaaaccccauuucuacuaaaaauaugaaaaauuagccgggcgugguggcucaugccuguagucccagcuacuugggaggcugaggcaggaggauugcuugaacccgggagggcagugagcugagaugaugccacugcacuccagccugggugacagagcgagacucugucaccaaaaaaaaaaaaaggauuuacuccaguauuuguucgcuuucuucagguagcugcuuuacacgugcauuuucucagcaauuaagggauacugagaauuaccaucauuaugucaauucaacaauacuuuccugugguggggggggucucaugucaaauauuucucuaguaaagugaaacugcuugacuuucaggaaagacaggagacuugugguuccuacuucuaagcuuauuuuuuaaaaaccaaacauguccaagucacuaaguccacaaguuacuacauuuuauaaagaugaaaggacaacauuaaaaaugcaguucaauagucaugacaaagucugaaauaagacaaaaacaaaacuuacagccugaaauuauugugauuccauaaacauucuguucaagcuguccgaauguaagaauguugcaagugagcugaauauuuaaugaagcuauaucuguaaaggugacacuggaugcuguucuguuuaugauaguauauugcuccuuaggaauaguaaaaugguuuguuuuccagacaauguaauuagcauuuacaugaaaauaauccauacauuuuuccuuuagcacacaaacugcagugaaauuagaaugaaguuguacaacuggagauucaggacugauauaaccacauggaucuagaaguucaccuaaaaaggaacaauagaaaauauauaaauggacugaauuuuucugguacaaaaugauaucuagcugguagcacucaauguagagucccucaaccgucacuaaaauaucccuaaagacacagaaaaagacaauacacaacugaaaauuaauaugguuagaauuuaaugccugaauuuguaaagaaauauacaaauuauaaagauaauagagcugaauuaagaaaaacccauucaugcuuuauagcccaugguauaaacuauuucuuuaagaaacacagacugccugcagcaugauucauacuugccccacaacguauccugucccuccauuuagaucccaggucuaaacuaaacucuccagaaaacaggcagugguggucuccucuacaguccugaaugcuguuguggaguacaguuggggucacagacaguauacauuguccacacaucaaaacucagacaacaaaggaaacagcaagggaccaauacaaaacaggaagaauagaacaagauggccaaauaguuuaguuuuaagaauaaaugcauggcccuggguaugaugguuugcgucuauaaucucagcacuuuugggaggccgaggcaagaggaucgcucgagcucaggaguuugaaaccagcuugggcaacauagggagaugccaucuguacuaaaaacaaaaaaaauuagccgagcaugguggugcacgccuauagucccagcuauucgggaggcugaagugggaugauggcuugagcccaaggggucaaggauguaguaagccacugcacuccacccuggacaacagagugaaaauaaaugcaugggauaggauccccuauuuaaaaacaaagaaucagccuaaccaacaugcuaaaacccagucucuacuaaaaauacaaaaauuagcugggugucauggugggcaccuguaaucccagcugcuugggaggcugaggcaugagaaucaccugaacccaggaaguggagguugcagugagaucacgccacugcacuccagcuugggagacagagugagacagagucucaaaaaacaaaacaaaacaaaacaaacaaaacaaaacacaaagaaucagauuggguaaaagagaauuaaacacaacuacaugcuuuaccuaucaccuacuccacauugaugacaucucaaucccuaucucuagcacuaaacccccaugcuuucaauagcccauuagacauauaucuaccugagauaucccauagcuauuuuuaaaugagcauguccaaaacuauuauguaucauaaucuuuucaaacuuauuauuuuuuauucuuauuucucugccucugcuaacagcaccacucccauccagacauccaggacagauacucuguagucaucuuccaacaucuccaauuagccuccucuaaccuccaacuuaacaauagugcacuguauugguucuauaugcuuaauaagcauaucaacaucuucuuuccaaugcuacuuugacugcugaagcacaggauacuauaucagucugaccuccuuccaguuuaucuuacauacuacugucaguuacuguucuaaaauaauuaggacauuugucuacuuuaaauuauuuaguggcuaccuacuaccaagauaaaagucccaacuauuugacaugauuuuauucuuuuucucuagcuucaauguccacaauuuuaagguggcuuuccucaaugaauccuauuugcugugggguuccuggguaguuacccaugaaguguuuuugagauuaaaaauuacuagccugggcaacauggcaaaaccccaucucuacaaaaaaaauauaaauauuagccaggcaugguggcacacgccuguagucccagcuacuugggggugagggucgugugcugaggcaggaggauugcuugagcccaagaggucaaggcugcagugagcccagaaaaaauuaaaaacaguuuuugcagucaaaauuguauccccaaauggaaucccaggaccucucacaaagccuguaaaacccagagcuggaauguguauuucuuuguuucaaacuuauaauguggucuguuuauaucaucuugcuguuauuuauaaaugccuacuguaaaucuuagugcauauauuacucucaauuuccaauagcaugguccuucauccaguggagaaucucuacuaaguuacucucugauacugggucagaccuuacaauucccuagacaucacuuuauucuuuggcaaaaucacuuguuauacuuucucuaaaguaaucauagggauguuaaauaugaaauauacucuagaguucuaaaaagauauaauuagagacucaguaugaauaauuuuuaaucacacagaauaagagaaauauuaaaaaugggcaaaugggcugggcgcaguggcucacaccuguaaucccagcacuuugggaggccgagguggguggaucacgaggucaggagaucaaggccaucguggcuaacauagugaaacccugucucuacuaaaaauacaaaaaauuagccgggcgugguggcgggcgccuguagucccagcuacuugggaggcugaggcaggagaauggugugaacccaggaggcggagcuugcagugagccaagaucacaccacugcacuccagccugagcgacagagugagauucagucucgaaaaaaaaggggcaaauguuccguuuuucaaagugagacacagcuucaauaauaccaucccaugucaaauuaaucccauuuuacagggcuaccaggcugagauuaaauuguaaaaagaaaguauuuuaauuaagaaagguaucugauaaaguuauuuugaauguuuauagggcaagaugaagaaaugugaauuagaauacacuauaacuggguuggacgcagugacucacgucuguaaucccagcacuuugggaggccgagguggauggaucaccugagaugaggaguucuagaccagccugaccaacauggugaaaucccgucucuacuaaaaauacaaaaauuacccgggcguggugaccugcaccuguaauuccagcuacucaggaggcugaggcaggagaauugcuugaaccuggggggcagagguugcagugagcugagauugugccacugcacuccagccuaggcaacgaaacgagauuccaucucaaaaaaaaagaaaaaaagcaaaaaaaaaaagaauauacuauaaccgauauuacaaugaacauuaugaaauugcugauauuuugcuacuuuuauagguucauacucaaauuuauauuugauuacccauauauaaaaaaacugacuuaagaaaaaagucaauuagaggauagucuuaaguagaauaugcugaagugcaugcccucaauccuuggagaagacuguauuuuaagaauggccacaccuacauauuuaucccaucccacguuuuucuuacgaugucacgcauacucuuuucaugaagagguggggacugcauuucccccaaccacaucagaucuguaugggugccuuguguccacuccagccaauggagugugcuaugagacuucagaggcuagaucauuaaaagaauacagacuccaauuagcuuucuuucucucucccgggauaucugcccuuagaacccagccacacauuguaagaaagccagggccauaaaaagaggccacguaugguguuuuggacaauggccccagcaaagcccucagccugcagauaccauuaacaacagacauauaagcgaaggagucugaagaugacuccagcccccagucugaauauugcagcugaggccccagacauuguacagcaaagaugaauacgucugauugugccugccuaucuauagucuuguccuauacaaaucaugagagguauuauuaucauuuuaagccuugaagauuuggaguauuugugaggcagcaacagguagcuaaugcaguccuguuauuuucaacauuuuaaucaacaacuugggaaaagacagacacacaugcuuaucaaauuagcagaggacaggacuacaaacaacugccaacacuucggaugaaaauguugggauuuaaaauuaugcugaaagaguagaacaccaggcuaaaacugauaaaaugaaauuagcaacagaggaaauauauccuauuuagguaauaagaaauauacauugggugagggagaacuaguuuaagaguaacucauguaaaaaccaccugagaauuuucacugaucacuagcucaacaugaaacaaggguauaucucagcuaccacauaguuacguaacuuuauaaaaaugauguucagaucaaaguaaguaugagugccacuguagucagauugguuuugguauauuacguuuauuuuuuucauaaagaaacuuuuauucaaagacaacaauaaccuuuauaauaaauaugcaguaacuaucauuuuuauaaugcuuacuguaggccaaacacuguccaaauauuuccucuauauuaacuuauuuuugguuguuuuuugagauagggucucagucugccacccuaggcuggagugcaguggcacaaucuccacacaccgcaaccuuugccucccggguucaagugacucucccaccucagccucccaaguagcugagacuuucaggcaugugcuaccaagcucagauuuuuuuuuuuggaaacaggguuucacucugucacccagacuggagugcaguggugcaaucuuggcucacugcaaccuccgccucccaggcucaagcgauucuccugccucagccuccugaguaguggggauuacaggcgugcggcacuaccgccuggcuaauuuuuguauuuuuaguagauacgggguuuuaccauguuggccaggcuagucuugaacuccuaaccucaaaugauccacccaucucggccucccaaagugcuuggauuacuggcaugagccaccaugccuggccucuauauuaacuucuuuaauccucacuaauaacccuaggagguaguggccuuuauuaucaccauuucauagaucaggaaauugagguacagaaaaugacugaccaagguccuacagcuaguaagggggacagcugggauaguauuauucauacacacacacacacacacauacacacacacacacacacacacacacguacacauaaauauuuuuacgagacagggucuugcucuguuacccaggauagagugcaauggcgugaccauggcucacugugaccucgagguccagggcucaugauucuccuggcucagccuccugaguaguugggacuagaggcaugauaugguuugaaucuguguccccacccaaaucucaugucguaucauaauccccaguguuggagguggggccugguggagaggugauuaaaucauagggguggauuucucacuugguacugccucgagaugguggaugaggaaugaguuauugugagcucuggucauuuaaaaguuuguagcaccuucccuuucucucucucuuccuccuguucucgcuaugugagaugccucacucccccuuugucuucugccaugacuggaaacuucccaaagccuccccagaagcagaugccaccaugcuuccgcacagccuacagaacugugaaucaauuaaaccuuuucuuuauaaauuacccagucucagguauuucuuuauagcagugugagaauggacuaauacuuggcuaauuaaaaaaaaaaauuguagagauggggccuugcuuuguugcccagacugaauuccuggacucaaguuauuuuccugccuaugccucccaagguucugggauuacaggugugagccaccauguccagccaguauucuauuuuaaauguaauacaggcaacuaagagaagaaucaguaggguaaucagcaugcacaggguuaaaaaccagauccuauagaaugauuagauaucuggguaacuguaauuuggggacaaggacuuacagacacaggaaagcagcccuucaauaccugaagagcauguaguaugaaugacguaaaauuuaacaagauuuaacaaauuuucuccuauucauuuacugaagaaaaaaaaaaaaacccacacacuucuuuccuuccccauuuuaaaguuauuguuaguauugauauacagcauuuaagauuacugacuuaaauuacugacuuagcauguaagaugacuguuacaacucaaauuauacaaaaacagauuaucaagaauauuuuuauuaaaaucaauuuaagauauuauucucucgauuauccuagaaagaauauaugaacauaauaauuaaacauaagcuuaauuauauaauaauauaaaaauauauaaaccuaauuugugaaguuagaagauaggguauuucaugaaccuuaccuguagauucaguggugaggaaaauaaacaaggcuugcacuagccaagucugcaacgucaacaucuugcgcggauauuucugcaacagacacauguaauauuacuuuuaauauuuuuucucuuauauacacauaauuuaagacacaaucuuguuuccaugcuguagcuguguuucuaaaaggugguaaaauucuuaugagaauguagaaaacuuaagucuucacauuauuuuucuuuauucccacugaaguuauggcuauggaaaacacugcuagaaaacauaauuuauacuuuaagguuaauuaaaagagauaucuuguuucuuucuuaugugaagucuuauauuaguaaauaacugugagauuaagaacuucagacugacaaauuucuacauggcaaaacucaccauaauauguauccuuaaaagauaccugacaaauggaaaaaaauguuuguaauucauagcauggccaaaaauuuucccgauauauaaagaaugccuacaaaucacuaaaaaauucuaacaccuaauagaacaggcaaacauauuugaauaguuuauagaaaaggaaauacaaguaaaucaagcaugugaaaagauacuuucaaccucacucaaaaugagagauauaaauuagaacuacucagauaggaacgcaaaaugauacagacacucugguaaacaauuugauaguucguuaccaaguuaaaagcacaccauaagacuugguauuuccacuccaaagagcguacuccccaaaauaaaaacauaugcccacaauaagacuuauacucaaauguucacagcagcuucauucauaagucccaaacuggaaacaauccaaauguccaccaacugcugaauguauaaacauacauucaaacaaugguagagacauauaauagaauacuacucagcaaacaaaaaaaaaagaguaugaacuggugauacaugcaguaguaugaaugaaucucaaaagcauuacacugaauaaacgaagccagacacaacagguuauacauuguauaacucuauuuacaggaaauucuuuuuuuuuuuaagagaugggggucucacuauguugcccaggcugucucaaacuccugggcucgagcaauccuccugccucagccucccaaagcacugggauuacaggcaugugccucagaaauucuugauacggcaaaacuaaggugacagaaagcagauccaggguugccuagggcugagguagagaaggcacacguaaaagggcauaaaggaaaucuggggugauaaaaauacucuaugacuugauugugguggugacuauaagacucuauacauuuggcaggacgcgauggcucacgccuguaaucccagcacuuugggaggccgaggugggcagaucacuugaggucaggaguucgagacgagccuggccaacauggugaaaccccaucucuauuaaaaauacaaaaaguagcuuggcgugguggcgggugucugugaugccagcuacucgggaggcugaggcaggagaacuguuugaacccgugaaacagagguugcaguaagcccagaucaugccacuggacuccagcaugggcaacagagcgagaccccgacacacacagacacacacacacacacacacgccagguguggugguguaugccugcagucccagcuacucaugaggcuugaggcaggagagcuguuugaacccggaaggcaggggcugcagugagcugagauggcaccacugcacuccagccugggcaacaaagcgaaauucuauuuaaaaaaaaaaaaagacuacauuugucaaaauucacugaauucugugucaacuguuucaaaggcacugagauuuuaccuuacuuucaagcuaacaagucagccuaccacagugucauggauacuggcaaaaggcaugacauuuuugcgucagaagcaaaggacuguauuacucauaacaguagucagaguaucagcauuuucuugcgccagcugcuugagucccaacugucacagggcauugugaagucagaugacaccugaacaggcugcuucacaggaaagaaagacagaucuuaaguaacccuaaacuugaaaaauaugcaggaagcaugucugccauuuacucuagagggagacauuaucuguaucuuugaagacuguaaguaagccuguccuuugcuccacggcucugagagucuaccuuccaacauucuuuaaaagguaaguuggcugggcaugguggcucacgccuauaaucccagcacuuugggaggcugaggcgagugaaucaugaggucaggaguucaagaccagccugaccaacauggugaaacccugucccuaauaaaaauacaaaaauuagccaggcgugguggcggccgccuguaaucccagcuacucaggaggcugaggcagagaacugcuugaaccugggaggcggaggcugcagugagccgaggucacaccacugcacuccagccuaggugacagagcgagacuccgucucaaaacaaaguucagaaaaaaggcagccaucaggguuuuugcugauaagaaacgcagaaauguuagacucauggguuuccuaucaaguuguaacuaaaaaauggugaauuuuauuguuuauaaauuagaccuuaaaacaaacaaaaucugcccagauaagguauaaccaaaagaaacgagugcuuaauaccuccaaagacaucuacaagaauguuuacagaaguuuuauucaaaauagaugaaaaauaaaaucaaccaaauaucuauuaacacuaggauaaauuaugguauauucaaguaauugaaucacagcaaugaaaaauaacaacagauacaugcaucauggaugaaucucauauauaauacagaaugaaagaaaucagacagguugggugcaguggcccacaccugucauaucagcacuuugggaggcugagggggaagaauugcuugaggccaggaguuaagaggccagccugcacaaaauagugagacccugacucuacaaaaaaauuuuaaaagagaaaaaaggcaagaaaguacgcucugcaugauuuauuuuacagaaguucaaaaagaggcaaaagucuacgguguuuggugacagaggucagagcaguuguuuuuugugaggaaggguauaaaaggggacauucugggugcugagcauguucuguaucuugaucuggacagugauaaauucacugagcuguacacuuaugaguucuguuuugcaguauguaacaaaagguaaacaaaccaaaaauuaucccaauaccauucuuacauauuaguguuggcaaaaauauaaaaacccaaaaaguaucaacaggguguugugagacuaagcaacgaaaguaucgucacacacuacagguuauaguguaaauuggcauaagcuucccaauacauugaacacuuuaaaaauggucaguuuuguuguuuguaaauuagaccucacuuaaaaacaaagaaaaaagcucuacccaaacaaggcagagagccaguucggcaauaucaaucaaaauuaaaacacacacauuugauucuaaugauucuacuuuauuuuauccuacagauaugaauaaaacaacacauguacaaaguuauucacugcauuguuuuuaacaguaaaaggcugaaacaaccugauuaugaugggacacuaguuaaaugaugguauaccaaaaccauguaaauguaaauacuuguagccauuuaaaaaaaaugaggaagcucuauauguacagaaacauaaaguuaucuaaaauacauuguuacauuguuaagguacagaacaacgcauuugcuauuauuugugggcaaaacaauauacaagaaaacaaaacacacauucguuuuuuuauauaugcacaguaucucuaggaggauaaaaguucaaauacuggcugugacaggguauuugagagaucagggugguagggagacgcuccaccauauacucugcagccuugcaauguugaccaugugaaucuuuaguacuuaugcaaaaaauaaauuuaaauuaaaaaauacuuaaugucagcuaggugcaguggcucacgccuguaaucccagcacucagggaggccgagguggguggaucaucugaggucaggaguuccagaccagccuggccuacauggugaaaccccguccauacuaaaaauacaaaaaguagcugggcgugguggugggcaccuguaaucccagcuacuugggaggcugaggcaggagaaucacuugaacccgggaggcggagguugcagugaacggagauggcgccacugcacuccaggcugggcgacagagugaaacuccgucucaaaaaauaaauaaaauaaauaaauacuuaagguucaaacuauuggguacuaugcucaccaacugggugacaguucaaucguacuccaaaccucagcaucacacaauauacucauguaaccuguacaugaacucccugaaccuaaaauaaaagcuaaaauuauuaaagacaaaauacuuaauguguaauuuuuuucuucuaaauaaaacuauuaacucuucuugaugagaaauggcuuccuaguucugcacuuggaacacaauauuguuuuauuaaauauacauacuaacuugauuuuaugcacucccuaaucauguaacagcuugccagcaugcccagcuaauuuuuuaaaaauuuuucuguaaagaugggggucucacuauguugcacaggcaggucccaaacuccuggucugaagcaauccuccuucuuuggccacccaaagugcuggaauuacaggugugagccacugugccaagccaaauguacuauauucuugcaacaaagcugcuccagaacaagagguccaugaaagaauuuaugauuacuucaaagcaauuagauuuguuugaguaguaccauggaacacaagcaaagcgaacuaggcaaagguagauuccacauuucacauuuagaaaguaaucuuuccuaauuuuuaaaagauuguaauggagaggugaugaagaaacaucuauuaugggacuugauuucauaguccaaaucuaagagaugaagacacaguaacacuauauaaaauauuauaugcaauacaguuaacuucacuuggggcuugcuuaaaaauugacagaauuauggccgggugcgguggcucaugccuguaaucccagcacuuugggaagccaaggcaggcggaugacaaggucaggaguucaagacgagccuaaccaauaugaugaagccccgucucuaauaaaaauacaaaaauuagccgggcaugguggcgcacaccuauagucccagcuacucaggaggcugagguaggagaaucacuugaaccugggaggcggagguugcagcgagccaagaucgugccauugcacuccagccugggugacagagcgagacuccaucucaaaaaaauaaaaaaaaaaauugacagaauugacaguaguuugcuuauuuuuucccuccuuuccuucuguugauacuaauauuuaauuuaaaauuauauuaauagcacuauuaccucaccucuugcagaguuuucuaugcauauauuauaaccauacauugcauacacuaaccuuccuugaaauuugcagguaacuugagaagcuucuaugaagccaaaaccuaacuaguaaccauaaauacaggaaagauuauuucugaaaaccaaaagcuguaaucauuccucaacuauggugauauaacaugguagugugccgaaaggagcuagaugauguauaacaaguauugcuacuuuuaauguuagagaaacaaaguucauaaaugauuuauuuaaaauagaauaaauucaagauuaucccuauaguuguucauucucauuuacuuucauuuccauauguuuucucaagugagagaaaaagcaguagaguuacaauggauaaauauuuaaugguuaggcucuuuauaaauuauuuuugucaccuauggauugugauuuuuuuuucauuuucuaacuuaaccuaaggaugaaauaaaaagcacgaauauauuuagauuuacauugcaugugaaaaagaaugucaauauaaacuuuguuacuaugguaacauuacuauuacaauuguagaacaguauaugaacuaaaauugccaaauagaaggcaaaauaaugcuuguugaauuaauaaguugcguggggaucaagaugaagaaaauuucuauauaucuuucacaguacaguguuacugugaauaaacugccagaaguugguaauaccuacacaaaauuaacuaauuauuaaauuaguuuuuaaauuauccacucuguucucuuccauuaguaucaauuaugaguucauaacaauuaacacuaggauauuauuuuacauuacacaaaauguugucacauaaauuauuucacuuuagucuccuaauauccuaaagaaucaggugaguagggcagggauuauuuauuggaacuuuguaaaauaaaaaaacaaaaaauucagacaagaucaauuacuuacccaaaucacaaaauuaguaagugaaggaguagggauuugaagcuaagucuucuacuucuaaaugucaugcuuuuuccauuggguuucacuguaaagagaggagagucuuguucagaaggcuggcuuugauaauuuuauuauauguguacuuuaaaaauccccaucugcucuuaggcuuuuggguuugcagaaaguauccuacuuuagauauguucugagcuucagaauaaaauaaacccauaaacacuuguauaagaguauucaaauauucuagugcuuuuuuuuuuuuuuuuugagacaaugucucacucccaucaccaggcugcagugcaguagcacaauuacagcucacugcagcuugaacuucccaggcucagguaauucucccaccucagccucccgaguagcugggacuagagauggcaccaucaugccuagcuaauuuuuuuauuuuuaguacagauaguguuuugccauguugcccaggcugagcucaaagggaucugcccaccucagacucccaaaguguugggauuacaggcaugagccaccgcgcccagcccuagugcuaugauuugauauacgcuugcaaacauuauuggcucacccacaccuaaugcaaacuucccugacgucuauguaaugucacagaaacaugacaggaacauuuaugacagacggaguucuuuaacaaucacauauuucuucuucuacuagcacuaaauuaagccugcuaacaacuauucuauguaaccagagauaaaaauccauuuuaagauuuguucacuuaaauucuagcuuaaguacuagugcuccucuuugaaauacaacaaguaacuucaaacuuaggcaaggaguugaaucuuccauuauuguuucauacacauuaagccuuugauauaacuuaauaacacauaaggaauuaaauuuauaaaaauauuuuuuaaaugucuaaugaaaagaaacugaaaaaaugccaugugaaagugcacuauaaucccaccaagagauaacuaccaugaacauuuugguggauauucuugcaaaauuuuuuauacauguauuauauaacuuuacauuguauaaauauacacacuuuucuauuuuacaaagaugggaucauguaagugagaaauguuuuauaaccuuuuucacuuaacacuacauaguggacaucuucauaaguuaauauauagagaguaauuccuuguagccuuugcucaaauucaccuccucauagagaucuucccuaaccacccuguguuucuuauaccccuuuacugauuuuuuuuuuuucuacaacacuuaacaccuucuaaaauaggcuagcaaacauuuucuguaaagggccagauaauaaauauuuuagauuucgugggcuuuaaguucucucuugcaauuaguuaacuccguuauuaaagugcaaaagcagccauacacaauauguaaauaagugggcauagguauauucccaugcaacuuuauuuauaaaaauggcugcaagcuggauuuggcuuaugggcuauaguuugccaaccccuguucuaaauacaauauaauuaaauuaauuuucuuuuuguuuguuaugggcugaacuguuccccccaaaaaauauguugaagucuuaaccccaguagcacaaaauguuacucuaugggcagauuuaauuggauguuauaguggaguauaauaggccuuuaguacaauaugacuggugucuuuaaagagacagagccaggaagaauaccaugugaauacacaggcagagauuggaguuaugcagcuguaagcuaaggaaucucaacgacgauggcuaccaccagaagcuaggagaggcaaaggaagauucuauccaaagucucaaaaggacuucuagccuccaaaaccuugagagaauaaauuuguuguuuugagccacccaauuugugguacagguugaacaucccaaaucuaaaaacugaaaugcucuaauuccaaaacguuuugagcucuggcauuuuggauuucagauuuuaggauuugggaugcuuaacuuuaaguauauaaugcaaauacaacacaaacugaaaaaaaaaaauccaaaauccaauauacuucuguuacuaaguauuucagguaagggauacuguaacaaagggaugcucuauuacaguagccccuaggaaacuaacacauaguguguguccccaaaauagaagguaagugaagaguggaauggcuaggcccuacggcaggugugugcuuggcuauaucuucuuugaugaugugucuguucaaacauauugaucaacuggguuuccuguuuucucauuaaguuuugaaaguucuaagaagauauucuggccuuuauuagaaaauggauuuacgcauuauuuucuuguaugcuugucuuuucauucuuuuaacaguaucuuuugacgaauaggagguuuaauuuuaauaaaguucaauucaucaauuuguguuuuugauguaucuaagaagucuuugcuuaaucuaaaaucauaaagggcccgacgcaguagcucacacuuguaaucccaucacuuugggaggccgaaguggguagaucaccugaguucagaaguucgagaccagccuggguauauggugaaacccugucucuacuaaaauauuuuaaaaauuagccgggugugguggugcacaucuguaaucccagcuacacaggaagcugaggcaagagaacugcuugaacccgggaggcagaggaggcugcaagugagcagagauagcaccacugcacuccagccugggugacaaaaugagacuccuucucaaaaaaaaaaaaauauaaaaaauaaaaauaaagucaaaaagguuuuuuccuacaaguuuuauaguuuuagggucauuuaggucucaguuauuucaaguuaauauuuauguguggugucaagcugaaauuugaguucauuuuguauauacggauaauuguuucaaaacuauuugcugaaaaaauuauccuuucucaagugaauugccuuugcgucuuucuuaaaaaucaguuguucacaggugugggucuauuuggcuacucucaauuccagggugggcaagcuuuucauguaugagguaggagguaaauauucuagguuugugagccauaaggucucuauuggagcuaccaaucuacuguuacgacacaaaagcaaccauagaaaauacauaaacaaacagggguggcuguguucuaacaguacuuuaugaaaacagaagguaggaugacuccuacucuauuuguuccacugaucaauuugcuuauuuauaugcuaccaccacacugucgugaugacuuuagccuuauaaaucuugaaaucaauauucugugugcacuuaaaaagcacugcugcugcugguagaguguuacauaaauggucauuacgugaauuugguugauaguguucaaaucuuccauauccuuacugauuuucugacuacuacuucuaucauuguucaaaaagggauauugaaaucccugaauauaacuguggauuuacuucuccuugcaguuuuuacccuguuguguuuugaaacuauguuauuugguagauccuuuugauaaauugacccuuuuaucauuaggaaaugcccuucuuuaccacugguaacauucucugaaaucuacuuugauauuacuauagccaauucugucuuacuuugauuaguguuaucaugacauauccucucccauucuuuuuuguuuaaucuguauguuucuucauauuuaaguggcaucuuuaggggguaggcagcaugugguuguauccaaucugauaaucucugcuuuccaauuggguguucagaccauuuacauuuaauauaauuugugauaugauuagguuuaaagcuaucagcuucauauuuguuuucuucuugacuguucuuuguuccuguuuacuuuucugcauuuauuuuucuuaauuauuuuuuauucucuuuuccuuguuagcuaauaagcuauaauucuuuguuuucuuauugguugcuuuagguuuauaguguacaucuuuaacuuuucacaaucuaucuucaaguaauauuaugucaccucaggcauaguauauaauaguauacuuccauuucuccccccagaccuuugugcuauuuuagcauauauuuuacuuuugcauauauuaaaacuucacauugguagcucccaccugaaaucccaucacucugggaggccaaggcaggaggaucacuuaagcccagaaguuuaagaucagguugggcaauauaguaagacucucgccucuacaaaaaauaaaaaguuagacagcugugguggugcaugccuguugucccagcuacucaggaggcugaggugagaggacugcuugagccuuggaggucgaggcugcagugaguugugguugcacuacugcauuccagccugggugacagagugagacuggcacauauuuacucgugugguuaccauuucuagagcuuuuaauuccuuuguauagauccguauuuccaucugguaucauuuuccuugggccugaaaaacugccuuuaacauuuuuuuguaguaugguuagagaaaagucuaaauagauuugaaaacaaaaccaaagugugaaugcuaacaaguauuuagccuaaaauaagcacaguucaaaaugagaaaagauacugcuaauuacuauauuaacagaccaaaggaaaaugacagggucauuccaacagauguuugaaaagcaucugauaacauucaacaacuguucaucuaaaacuuaaaaauaacaacaaagugucagaaaacuaagacugaaagagaccauccuuaccuuggugaaggauaacaaagaugauacagggacucuagaaccagauugcuuguguucaaauuucagucccuauauuuuaacaucuuaggcaaguuuuuaaauagccuucacuuuuacuuccuuuaucuguaaacaugggguaccaccaccaccuacccaucuaggaauguuaugaugauuaaauaacucauuauacauaaagugcuuagaaucauuuggcucauuguaacuacucaauaaaagguuaacagcuguuauuauuagugcagcucuugcuguugcugccacagguacuacuauaagaaaccuacaaggccaggcaugguggcuuacgccuguaaucccagcacuuugggaggccgaggcagguggaucacaaggucaggaguuugagaccagccuggccaauauggugaaacgcugucucuacuaaaaauaugaaaauuagcuggucgugguggugggcaccuauagucccagcuacuugggaggcugaggcagaagaauugcucgaacccgggaggcagagguugcagugagccgagaaugcaccacugcacuccagccugggcgacagagugaggcucugccuccaaaaaaaaaaaaaaaaggaagaaagaaaccuauaauaagcaucuauagguuuaaagguaaaaauuagaagcguuccuauuaaugucaagauucagacaagaugcuugaagucaucaguuauucaccacugcucuaaagggcuuaagcaaaaauauaauaaauaagaucuaaaaauggaaaauaaauugugaaugauaugaucaucuaucaagaaagagugagaaucacaugacaaacuauuaggacuauugagaauuuaacacaguagucaaacaaaacaucaucaaaaaauaauaggacuauuuagaguuuaacauaacagucaaacaaaacaucaucaaaaaauagcucuccagcuggcgcgguggcucacgccuauaaucccagcacuuugggaggccgagauaggcagaucaccugagguugggaguucgagaccagccugaccaacauagagaaacccugucucuaauaacaauacaaaauuagccgggagugguggcgcacaccuguaaucucagcuacuugggaggcugaggcaggagaaucacuugaacccaguaggcggagguugcagugagccgggaugucgccacugcacuccagcccaggcaacaagagcaaaacuccaucuccaaaaaaaaaaaaaaaagcucuccuacauaccaguaauaacuaauuagaaaauguaacagaaggcugggugcaguggcucacggcuguaaucccagcacuuugggaggccgagguagguagauugcuugagcccaggaguucaagaccagccuaagcaacauggcaaaaccccaucucuauaaaaaauaaaaaaaaaauaaaaaaaaaaaucagccgggcaugguggaccaugccuguaaucccagcuacucaggaagcugaggugggacaaccacuugagccugggcuuauagaggcugcagcaagcuaagaagccaagaucuugccauuguacuccagccuggguaacagugcgaggcucugucucaaaaaaaaaaaaagucucgcagaaaaaaaaaaaaagggcagucuaaagguaaaguaaacauagcacugauuggcaaaugaauagacaacuaaaucaaugguacaaaacaaaacacacucaaguguauauaagaauuuaguaucugauuuuuuaaaagguugcucauuugcugggaaaauaaaggacuauucaauaaauaguauugggacaacuggcuccauaagcaaaaaagaaaaaaaagaaccccauuucaucagacaaaaagacacacacucaugcacgugcacaugcauguauaagcauacacucucucuccagauuaaggaccuaaaugcaaaagcaaaauuauaagcauauugaaaaacacauagaauaugcuuaugaccuuagggccuuuuaaaauuagacuauuuuagccaaaugaaaagguuuacagagcacuuugaugaacauccauguucucaccauugcuuaagaaauaaaagcucaagcuuuuauucaauuuuuauuccguuacaaacauaauugaagccauauaaauaguucuugccuuuaagaaguccaaaguuuagagaugcagaauaugcacaaagugccacaggagcacagaaaauacccaauucagacaggggccaggagcgcccagucuuaaaauaaggguagggguuccuagauagagaaaauagcacacauaugaacucuacaucaucuuugacucuaauugucaagugaagauuaccaaugacaaaaucccagagcaugccagucuaaccagagcuaugcuaucugaaacauagcucugauuaacucacuuugcacuagggggugggguuggggguaauacauaaaacagaacauccaaacaaaaaaagacugagcagaucaaucaaccuuagagcaaagggugaagcugauugcuuaaaagaaaaugaaacuuuggaggcagaacauuccaaauguaacagggcaacagauuuacagugcugaaaggaaugaaucuccugcucuggauauguauacacacagcuuuaaaacaaucaucuauauacuauagccauuuuucagccaauguagcucucuuauucacgaucaaucagcuaauuucuuauuaaaucuuacuaagauacacuagauagccgcaaaguuuaaaaaaaaaagaagaagaagagacuguagccauuuugacuauauauaucacaaguguuucugaagccuuucacauuguugaccaucccugguucuugaauuucuccuauauccugguuucuauguaaccagauaauguaguugaauucuuuccuuuauccucuuucuugucuccuuuacugaauucucugcuagcuuuuaucuccaggcuaugaagguacccaaagauaaaguacugggcaucgacuuuucuuuuuaaauaccaacuucuuugaagacaugacuucaacuacuaccuucaaacaaaauaauuucaagaauuuuggcuuggaucuuucuuuuaauuccaguuacauuucaucuucuuagauauucugucucugagucuuaucaauuuaagaggucuaaaaacaauacaccauagguacaugcucaugaacacauauacacauaaaugcccacccacuuuuuuuguuuauuauacuuuaaguucuaggguacaugugcacaacaugcagguuacauaugauacaugugccauguuggugugcugcacccguuaacuagucauuuacauuagguauaucuccuaaugcuaucccuccccccucccccuaccccaugacaggcccuggugugugauguucuccacccuguguccaagcguucucauuguucaauucucaccuaugagugagaacaugcgguguuugguuuucuguccuugcaacaguuugcucagaaugaugguuucuagcuucauccaugucccuacaaaggacaugaacucauccuuuuuuacggcugcauaguauuccaugguguauaugugccacauuuucuuaauccagucuaucauugauggacauuugaauugguuccaagucuuugcuauugugaauagugcugcaauaaacauacgugugcauguaugucuuuauagcagcaugauuuauaauccuuuggguauaugcccaguaaugggaugaaugcccacacacuuuuuaaaaagucacaaggacuuaccauuuuucccuaucuacaaacaacucauccucuucaacugccuaagucaauggaguccaucguuucucucaucuaugcaguacauuuuagcuuuucucaguuacaaaucuuauccugucuucucucccauaauaucuuucccacccaucucuucuuuuuacucucuaccacaaacuaaccuaauuuggacauugaucaccucaauaauuucaacuguguuccugcuuccagucucuuuccuccccaccaagcauucugaacauuguugguggaucacucucucuacaacacaacuuuaaaccugucauucuucuccucaacagcuuuuuaaagggugaauaauaaugccaaauauucuaacuauuuaagaaccuaaaauuuuggcuuugaugugccuauccaaucuaucuuuuccaauacucaaguuucucuauucuaaaaaaaaaaaaaaauccuuuccucagacuccucccucaagcuaccuuacuacuauacuucuagagagaacugcuugcaauugcaagcaaucuggcuuuuuuacuccaauaaugcugaaauuauucuuguaguuuccaaacugcaaagcaaauacuuaagcuccucauuuugcuugaccacaccaugccauuuauaauucggucuuaucuuucaucacucccuacuaaccaucccuguagacucagcaaaccacuagacuuccucuaacauaccuuguucuuucagucugugcuucuacauauauuauuccaaugucuuuccugacucugcugugcacuacaaacugcuuuugaaguaucaucucuuauauggaauuuccccccacuucaaacaucuuugcugucaguguacucuuacaucauucccuaacaggacucagaacacugcacaguaauuguuucacauaucuugauauccucagaaucuaccauaguuugaggcaccugguggacaauuaaggguggguuuuuauagacuuucugguaugaucuuauuuucuaucuacucgcugucgcucaagcguacuguauggagacgcaggauguaucaugguuaagaggucagauucugaagccaggcugucuauguaugaccuuuagaucuaccacuuagcugggcaaauuaauuaaccuucuugugccuggguuucccuauguguaaaaagaggauuuuauccuauuauuauuagaccuacuucauaauauuaugaagauuaaaugccuuaauaugggcaaagugcucaaaacagcaacuggcacaacauaagcacuaaauauauugccuguuuuaauuaauagaccuuaguuacugcugauccuuuccacaagcuaguccuauauuauguucuauauucuccauucuacauuuuguccuccauucgcuauuauuaaugggcugucuucauuuuucccuuuauccaaauccuacccagguuucaaggccaacuucugguaaauccuuugcucauuccaauccuuaaaugcucacuccaauccuuaaacgaucauucccuaauuuuaauaucuacaggauuuucugcaucacucugcauuuaauuaaaacugcuuugcauccuuguaguuuuuuucguauaaguuugucaauccaauuauuauaaacucuuugaagguccugauuacaucuccugcaccuuugugaguucguacagcagguaguaauugcuuaguauuugcuguguaaaauaauaaagcacaauaggaaccucaacucugaucauucugccuuugcaaucaaagaaacggagaagcugugagaacauuccaugcuucucuaggagccaagcugcaaauguauuagggccagagaauucugacucccauuaaaaugagcagcucugaaaggagggagcggggaaucccucccugccacuguagaggauuuauggguugcccuuaaguucccaaaccaaauuguggcacugggguuuuuaugagaaacgugucaacaugacaaaaugauucagagcacaggauuuggagucacacagaucuaguuuucagcgagacuccuguuuccuucucuauaaaggggacauuuuaacaccuacuucacauguauuuaacuuucgcccuaacacugaacugaagugcaaagccuuggaaacaaauuuaaauaaauugaaaauacugcaauucacaaauaagagugagaacaacauuuuuaguuacguaagacuauauuauauuaaauuagguggcagcaguauuuauaauaaucuaaauugccugugagaaaauuaaacugguauugucaauacauacuuaaaauaagaaaaaaaucccacuacagucuguccuuuuugacacuuucuccuuccuguaauuuuuuucuuucacucaagauuaaaaacaaacguucaagauuaucccuaaagagaaauaguuggaaagcacaauuuaauagcaaguugguucuauaaauguaauauuucaguucauaguucaaaaauacuuccaaauaggaauuaacaugaauuuaagaaauuaacauaauggcacacagcuaaacugaugaucugaguccguaauuucaaauuaagaguuguuccaacuugaagcuggcagucauacacaguuuaaaggguuuguuuacagcacugucaaaagcaaauaccacaaucuuucagaaaauucacccuggcauucuaauaacuaguuauuuuaaggcaguauaauuguugaaauacuucacaaacuaagccaaaaugcguuuccuucugaaggcaaaaaaaaaaaaaaaaaaaaaaggugacgucuuauuuuuaaccugugauuuuuuuuuuuuuucaguuucggauuaugaaauaaaaugcuguucauccacugaagaacagacccuugcuuccugcacuaucuucaaaaguuuaggucggaggagguaaaauuuuaaaaacugauuuguucuccuugggauacagugagauguggaauucguuaggaaugauaauuauuaauagaaaagaucaaaagaaggaaagaaacguuaauaguguuuauaagcauugugaacuuucaacaaagcugaaacguuacgauuucaagaugaaaaaacggcuuuggggaagggaaauccaccucgagaaugaagacaagugcggagcgaauagaauuucaggggagaugaaaaggggauugggaaaaacgugggaucugguaacaaaaagggggguuuguucuugaagggcguucugcggggcgggcguuaagaggggugcgugcgugcgccugggugaaguuuguacucagggcugcgauaaucgaggugacaaaguuguggaaguagaauucggagguccgggagcaggaaggggaaggaauguggggauuuccaggcugggcugacaaguuccgggcgcugcucucagggggaagggaggucuccucgagugccagauagcccguccgaaaccaccgacacucuaacuccagcuacgcgacccagcacccggccccuccucaccucaggccgcgccgccucgacccuccgcgucuccacagcgcacgaaccccuuggcgccaggcugggccagacccgucggccuggcaggcgcggcccccgguucagcugcgccggggcggcccagcgcgacuccgcgggccuuuuggcugcucgccccggcuccggaacacugucagauccuucuccgcagagguagcgcgccaccccagu

SEQ ID NO: 192459 - RNA, 28471 nt, Homo sapiens
gggcgggacuuccugucuucccuguugcggagcucugaagcggcucccugagggcgcugguuuugaacuggucuugugcgguuugcgcuuucucuuagugguuacaguuggcgcugucuccgcuuuccuguuucguggcgggcaucuuggccaaaacacucucccugccaccuuauuccucuaggguugugauuuuuuucuuucaccaagaaauaucacucgcugguaauuugucaaacugaagaaaccccugaagaagcagucgugggcaggcgccgacgcugcggcuuccagagcauuuuggcaaaucaaagccagggaccguugcugggccucauuuccgcaacuuuucggcuccgaacugcugugaguggaagacuuuuggugguuguuuugaucaggcuccuucuguaacuagagacuauagcauuuugaaagaaaugagauucucauucaugucaagaacagacuuguggauuuuugaguguuaaacauacccugacguaaugugcugggugaugagaacgcaagcgggaaugagacuguagagaugagaauggcaguguggguuggagccggguuaugguuuccuaugguaugccaagaaccuuagucauuacacuguuuguuguguaugcuugauuauuuaaaauuagaaaaccgccucaguaaagcuauuaaaaaaaagaccugaccaaagauagacuauuuuucccaaauuggaaucagaaaaugucuuccaucuauguaucagcacccguuuuuuccccuaaaauaccaaguagacauacccgauauauacguguguguuuauauauauaucuguaaucuauauugccauuugauaaguacguaaacaggugauguaaagcacuugguauggugugacuuguggaaaguuaccuaugucaucaauacuagagauggauuggagagagaagaaauuccagacaguugcaggaguuggagagucuauggccugaaaaagagaaagagguagagagagucagguuccaaagacagaaaaucaacaggacuuguuacaggggcauggaguggaaagucaaguuuuagaauauuggcugcuaacaaugagacaccauuaauucaaauugcaaauucaagaggagcaguuuacuuauuuuucaucauucaaauauuuauugugccauuuacuauuugccuaauacuguuuuagaugccagagauacuguuacauauaagacagauaaggccccugcuucgguugacuuuauauccuagugggagaaaauaaaaagcaaguaaauaaucaauuuugaugauagauucuaugaagaaaaaacuugaagagggaugacaaaugauugggagauguuugggaguaacuuuaacuuaguuggucguugggcccuuguaggaguuacauuugugcugaaaccuugaugaugauaaagaaccagccuugugauuagccaaggaaaagacaaggcaggcagaaagaacugcaaagaugggaaagagcuuguuuaaagaacauuuaaaaugccaauguaucuaaagugcccuguagaaguaggagagaguugagaaaugacauugggagagguagauaggaccagacuguguggccuuuguaggccauaguuuaggaguuuggauuuuaaguagaaauggaagguacugguggguuuuaagccacgaagugauagaugugauuuucauuuuaaaagaucccucugggcacuacuguaugcagacuggauuugagggaagagaugagagugaaagugcaauuaggggguauuacagaagccugcuuuugguaggagugauuaaguuccauuuuaguuauguugaguuugauuuaucuaugggacagggacauagagagcggucuagcaggcagccaccugaaagcucugugagaggucagguacauuuaguucucuagagaaagaaaauaauuaaaagugugugaaucuccucaggagagaccaugugguuaaauauuuacuuauauccugacauauccucagaagauuacagaugauaucaccuacagcugauuacauacauuaaaggggguaagguuaaaaaaagacaaggugggccaggugcgguggcucacgccuguaaucccagcacuuugggaggccaaaacggguggaucacgagguguggaguuccagaccauucuggccaacauggugaaaaccugucucuacuaaaaauacaaaaaaugagccaggcgugguggcacgcaccuguagucccagcuacucaggaggcugaggcaggagaaucacuugaacccgggaggcagagguugcagugagcccagauugcgccacucuacuccagccuggcaacagagcaagacucugucucaaaaaaaaaaaaaaaaaaaaaaaaaaaaaaaaaaaaaaaaagacaagguggggcauaaaagugacaucaguguuauguuaagaagggaugaaauguggacuaaggucaggucuugaagaauccuugauuuaagggaauggugaagaagaaugauuaaacuaaaaacagguagaagugaagaagaaaacuguggcagcccaauguuaggggagaaaaguaggggaaaagagaguuuggugcaagggaauguagacaaugcuguuacacguugaugagguuuaguaggaugaagacuaaagucauuggguauaagaagacauuggcgaccauugcgaaacaaugucaguaaagagauagaggugaaagcuggauugcagugaauugaagacugauaggagagaagguugguagugagugaauacuacacuugagcuguuuauagguaggaaauagggauaaagugaaaguguuuucuauagaacguuauuuuuuucuggcagguaaaacuugaucaucuugguaguagaaggggauaauguggaaggggaugggguuaguguuggaaaggaauaaaaacauuucauaagauugcuugagugccugcaaggcagcauccacagugcuggucacugucauauuuguuuucucuuuuaauacacacaacaauccuguuacuacucccauuuuacaaaugaggaacaaccugagacuuauagcuagcuaguaaaugguaaggugugaaugaaacccaacucuuuuuuuuuuuuuuuuuuuuaguugaucauucuuggguguuucucacagagggggauuuggcagggucauaggacaauaguggagggaaggucagcagauaaacaggugaacaaaggucucugguuuuccuaggcagaggacccugcagccuuccgcaguguuugugucccuggguacuugagauuagggaguggugaugacucuuaacgagcaugcugccuucaagcaucuguuuaacaaagcacaucuugcacugcccuuaauccauuuaacccugaguggacacagcacauguuucagagagcacaggguuggggguaaggucauagaucaacagcaucccaaggcagaaguauuuuucuuaguacagaacaaaauggagucuccuaugucuacuucuuucuacacggacacagcaacaaucugauuucucuaucuuuuccccacauuuccccuuuuucuauuugacaaaaccgccaucgucaucauggcccguucuuaaugagcuguuggguacaccucccagacgggguggcggccgggcagaggggcuccucacuucccagaaggggcggccaggcagaggcgccccccaccucccgguuggggcggcggccgggcggaggcgccccccaccucccucccggacggagcggcuggccgggucggggcugccccccaccucccucccggacggggcggcugccggacggggcggcugccgggcagagacgguccucacuaaccagacagggcagcugccgggcggaggggcuccucacuucucagacggggcggcugccaggcggagaggcuccucacuucucagacgggucggcugccgggcagaggggcuccucacuucucagacagggcggcugccaggcagaggggcuccucacuucucagauggggcggccgggcagagacgcuccucaucucccagauggggucgcggcccggcagaggcgcuccucacaucccagacggggcggcggggcagaggcgcuccccacaucucagacgaugggcggccgggcagagacgcuccucacuuccuagaugggauggcggccgggaagaggugcucuucacuucccagacugggcagucgggcagaggggcuccucacaucccagaugaugggcggccaggcagagacacuccucacuucccagaugggguggcguccgggcagaggcugcaaucuuggcacuuugggaggccaaggcaggcggcugggagguggagguuguagcuagccgagaucacgccacugcacuccagccugggcaccauugagcacugagugaaugagacucugucugcaaucccggcaccucgggaggccgaggcuggcagaucacucgcgguuaggagcuggagaccagcccggccaacacagcgaaaccccgucuccaccaaaaaaauaugaaaaccagucaggcguggcagcgcgcgccugcaaucacaggcacugggcaggcugaggcaggagaaucagacagggagguugcagugagccgagauggcagcaguacaguccagcuuccgcuaggcaucagagggagaccguagaaagagagggagagggagaccguggggagagggagagggaggaaacccaacucuuuaauuccccuucugucacugcuguauggagagcauaggugaagacauaguacuuuagagguagagaagaagaaacugaaugcagagaaauaaggacaaauccaagauaauaggagauuaaguugcucaguaguaauaaagagcuguuucuuuaaugcuaggguagagacaggauuccagguauuuggauuucuucuucaggguccuuuucccauaggccuaauaguuacuuucugccugucuuuggaauuuauauuacaaacaauuugcugcauucuuaccauaaagguggaauuugcuuauuauuugaaauuuaaaaugagauaaugagcauauaauuuauagaaauuaaauuucuuuaggccgggcgcaguggcucaugucuguaaugccagcacuuugggaggcugaggcaggcagaucucaaggucaggaguuccagaccagccugaccaauaugguaaaaccccgucucuacuaaauuacaaaaauuagccaggcaugguggcacacaccuguaaucccagcuacucaggaggcuaaggcagaagaaucacuugaaccugagaggcagagguuacagugagccgagaucacaccacugcacucuagccuggaugacagagcgagacuccaucucaaaaaaaaacaaaaaaaacaaaaagaaauuagauuucuucuugguuauguuccugcauuggaguaaacuucuagaaguuauaagcuucuaaauaauaagcauauaauuuacaaaaauuaaauuucaguagaagugaagcuauuaaaauuauaaagacaguuaucacuugugguugucucuucuugguuauguuccuccauuggaguaaacuucuagggguuaauuaaggcauuuuguuaaggauguucauuucagauuuauccaguguaguuaguauucuuaacaaaaguaaaugcaauggcaaugucaucuucuuagaaaaugcacgcacuuauuuugauaaaaguuuuguacauuaagagaacuauuuaugcuguuguuuuuccuauuucauucagucuuugacuuagaagauaucuuauccugccguuguaauggcagcugaacugcgaaugauacuuuaugaagaugauucaguacaaguacaauauguugaugguuccacauugcaacuuucucccuguggcacugaauuuuuauuugaaaagucaccaccuguuucagcacauccuuuagaacaaccagaaagaauucgucaaaggacacauuuugucauuagcacuuacagaguaaguaaagauaucacguaaacaacuuuuuuguuuuuuagagacagguucuugcucugucacccaggcuggaguacaguggcacuaccauagcucacugcagccucgaacaccuaggcucaagugauucuccugccucagccuccuuuuacaagggaguuacucuaggacuacaggugugcacuaccacaucuggcuaauuuuuaaauuuuuuguagagcauugucuagcuauguugcacaaacugguucucacacuccuggccucaaguaauccucccaucuuggccucccauuaugccaggauuacaggagugaaccaccgugccuggccaaaacuacucuuugaauaccaaaauacuguugacguggcuagaauaugaaaaguaauuaguauuauggauuauacuguacugucauuuuuaauugauuuucaaaucauuuuacauuaagguuacauuuuauauuucuuuucauaggagcaacuacagcgagcccuagauuuucgaaacucuucagcuacuugcccuuuuuuaucugaaaccaucauaccuucugaaagaaaaaaggugauuuuuuuaacuucauuuuuguuaguauuauuugaggacaaguaacuagaaacagguaauuuaauauuuagccuuuuuuuccuuuucaggacaccuggggauacauugcuauaaaacaucaaaguuacauaguguaucccccuugccauuuucuuuguauccaagcauuauaaucagaauuuuuagauuggugacuuuuucauucucagaggucucaaaauuaaguaauuaugugaccauuuucaguaacagcguauuuguuaauguauaguagaaauauguaacuauggguaugaccuuuauuauuuugcuuauauaguauuguguuuggacuuuuaggaauaauaacugucauuuacugaggguuuacuauguccaacaacuaugaacaauauuagaaauauuuaauaacaccauacugaucaaaauggauguccauccaaucaaaacagguauauuggcuagauggcagccucuuuuuuuuuuuuuuuuuucugagacggagucucacacugucgccagggcuggagugcaguggcacgaucucggcucacugcaaccuccaccucccagguugacgccauucuccugccucagccucccgaguagcuggggcuacaggcacccgccaccacacccggcuaauuucuugcauuuuuaguagagacgggguuucaucauguuagccagcauggucucgaucuccugaccucgugauccgcccgccucagccucccaaagugcugggauuacaggcgugagccaccgcgcccggccggcagccucuuuuuauaggcaaggaaauuaugucuuagagaguuuaccuaauuugucuauggcaguuuucucaguggcaaagucaggauuugaaccuagucuaucugacucuguaaacucuguuucucaacuacuuucugcuaccuuucuaugcugucaagaugcuugccugccggcugaguaauuuuauauugucucguggcaaaggagccauaaaaaauuauaaguuguaacuuagccuagaaugguaauuuuccauugugucuuuugagucacuuuauucacugaaacugccuagcuuguugcugaugcugcagcaggauuauuagauagucuaauucuaaaagaggaguuugaugaccauccuuacaaaccagcuuugcugucaguaaauacagcccucaauuuuaguguccuaacaucguacauauagauagcaugguaaauuuaggaagcuuucuugacaauaguuuguguaaacguaagauuuuacauaaauggaauugaaaugcuaaaugcuuggcaaaauuaauucaguaaaaaccucucacgcaauaucuacuguuuauaucuuauaugaaaagucacaaucaacacuguuacuuguuaugagucuuuuauuagucagaaucaauuuuucuuugaguaauuaaacuuuuuuaaaguuuccucuaagccuccugaaauuuauuuuaguguauggugugccagguacuaccuaggauggguacuuuuuacauguuaccuuauuugguucaugugauaacccugcaagacagaauuucccaaaugcuguucaguaauucuaguacuaguuuaaauaauuuucucuuuucccucuugcucugaaaaacuuauguuaucucauguaaauuuuaagauaugauugaguuuguuuuugaauuuucugaguuguucugucaauaauuuuuaugguaguccuguaccauuuaagcuaugguugcuuuuuuuuuuauuuaaaacuuaaagaaaaauuuuuagcuaugauugcuuuuaauauaauguaucauaguguuggucuucccuuauuucuaguuuuuuuucagaguaaacuuuugcagggugaggggagggauacaaaucuguuuaauucauuguacauuuaaaaccaaaauacauuuaacacuaaauaugaccauuucucucauuuugugucuguuuuacaucucuuuuuuuuaagggugauaaucuuaacaauaucaaacauucucuggaaaaucauauauaggcugagaucuggcccuccauuuuuucauucucuguagauaguaaaacacaaauauuuaagagcuuucuuacacaauacuuaaauaucaaauauauggaaaaauuggacuguuaacagaaaauacucaccgucucuuuuccccucuccuugcagcauaucuucauugacauaacagaagugagauggcccagucuugauacagaugguaccaugauauauauggagaguggcauugugaagauaacaucuuuagauggucaugcauaccucugccugcccagaucucagcaugaauuuacaguacauuuuuuguguaaaguuagccagaagucagacucaucugcaguguugucagaaacaaauaauaaagccccaaaagauaaacuaguugaaaaaacuggcaaaaucuguauacguggaaauuuaccaggacagagacugaagaauaaagaaaaugaguuucauugccagaucaugaaauccaaagaaacuuuaaagaagaugaguuguguaaauggaacugaagggagggaagagcugccuucgccugguacaaagcacacauguguauacacaugggucaagcagugcuggucuguggcugccuguccagaggaauggaaauauccuuugucuuuagcacuucauuuucauaauaaaaucagcaauaugucuaaaauugaugcacauauaacucagaguagauuuuuaacuucugauauuucagaggaaagaggaaaagugguuucuguucuucccagggcccugucacucagcuguccagucccacaccuacacagguaaugcaguaauggcuauuggucaugaagcuuuuuaucagaaccagucuuaaccuggauaauuuucuuuuuaucugauaccauucacaaggaaaguuuaucucauccaaaauuuugcuuuuaacugauaguaaauaauuucccuagcaaauguguugcuuauguuuuuuacucuguguccaugcauugaauguagaaggcugacucuacacuagauacugugcuaaguccaguaacugcagagaugacuaagacacagucccugcuuuauagcaacuuagaaucuagugaaggucacuguaccuaaaaagauuauuaaaguaugcuaaaugaugggacaggagucugcacagggcucugugggcccaggggagcaccugcugccgcucacuggagcccgugaccuugcuugcuggaguguggaucugacacaguucuuuuguccauaccuagcuucagaggcuacccgugucuuugguucacugacuauaaauacgucuguuuucaaaagggguacacacggaguggcuucuguaaggcuaaguauaaaacuuuuaacuccacuaaggauuguagauuuguaacaucaacuuugcauaaacagugcaaaucauaaugauaaaaacuaacacuuacaaaacacuuaugugccagguacuguuggacuucacccguuugauucucaaagcauucccaugaaguuaaaaaacguaucaucccuauauguagaggaacuugcgacauagaaauguuaaauaacuugaggaaagguacacagcuaguacuuguaaaauugagauuugaucccaggcaaucucugaguauacauuuguuauuuaaaacaaaaauaugggaaugacuguuaggcuugucaugauuaucugguuaaaaugagaaaaguauuacgaguacacaucaaaagggaauuaugcuucaaaaguaaugauuuuucaauaacuuaccaugauguuuagguugaaauccaugauccuucacauagcuuaccaggucuuuugugaccuggucccuuccuauaucuguaauccucaacucucucacuacucuugcccuugcuuucucuauucuugcuaagcuggacuuuagcaaucccuaaaaugcuugcucaagcacucugugaccacugcaccuacucuuuacucugcaggaguguucucuuucucucucagcuggcuaaauuaugcucauuuccagguuucagcuuaaaccuaacuucuuuagagugguuuuccugaagacccuaaacaaguuaaguccuauacaauuccauagcaugcaguacuugccucuucuuuacacucaauguuuauuauuuaaugucccugcugagggcagagaccaugucuacauuuuuuugguuguuauauccacaguguguauagcacagugcuuggcccacuauagauauuuuaguaauuuuuuuuuuuuuuuuugagauggauucucgcucugucacccaggcuggcgcgaucucagcucacugcaaccuccgccucccggguucaagcgauucuucugccucagccuccugaguagcugggauuacaggcacgugccacuacgccuaauuuuuguauuuuuaguagagacggguuuucaccauguuggucaggcugaucucaaacuccugaccucgugauccgcccgccuuggccucccaaagugcugggauuacaggcaugagccaccaugccuagcgaauccaggcuaaauuuuaaauguuauuaaaacuguuaauuuauguaauugugcugagauucaauaaugagauuauugaaaauagugaaaaaaacauggaaaaagacuugcuuuuuacauuucauuaauauaccuucauauuaauuuuuauucuuugaucuagugaguuaaacaagaaauuaauccuguuacaguagcaacauuuuguugacuucuaaagacaauuauauugagcaaccagaaguaauagcuuguauuuuauccuucacagguggaauuuuugugauucacuuuuacagagacaaucugaugaauauuccuauccugaacuagugaaaaugguuugguacaaagguguuacauauagguaaggcaccuauguuggcuucuauguuggaguuagagcuguuuauugaugucacagagaagaugggacgagccuuauagacagacucucagaagaggacacaguucuguugggccaacugugcuccuguguuugauccugaguuuuacaggucucaaaacuaauguuauuagugcacacaaggguccugugacucacucacauuaaccauuuuuauaagacuuaugugguaccuccaaagccaaugagggauugguuugcuagugaauguaacauucauaucaguuauuuaggauacuccuuccaagcauuggaggaucaaguuguuugaaauagucaaaacagaauugcuugagcauggaauuagagaaguuagaucaccuaagggagauuuuagccuucauucacaaagcaaauacucauugaguggccacucugugccagcacuguuccauugaauuauccauaccccacaacaaaggacacccuucuagugacuagaauacuaguguuagccagauugagaguuucacuuccaugaacaaugcuagaagagcacugcuaaauuuuuggagagcgagggggcucuccuuuuccuaugugaagaccuauuccuucuaacaacauauucuaacauguauguuaauaaaauuaacuuggcuuaaguuucuauuugguauauacccaguaccuugauuguaccuggcugcuccagguacagccaucuuuucuuagggauagccccuugugcagacggcuaaucuuauccauaaaguauugauuccgcuaguuucauuaaucuauuuucagguucuggaaauguuguauuuaacacguaugcaauagacauugcuuuggugacccuuauaugccagccuugugauuagcaguggggauaucaagaagaugauaagacaagaugccugaauuccagaaguucuuaguuuaguuguugaaauaaaugcauaagccaauucuauuuaucuuuucgugaaagaguuaauuuagcugguuggguucagaauaugaaauuaucugcuucacuggacaggcaaaaagacuguguuguuuugcuuagauuuuguuguuacuguuuuuugaugacuaucuucaugcauguuuuaaucucaaguggaaaaaaauuuuuaaugguuauuucuauuucuuagacuuacccaucaaaauaugaacucaauagagauuuauucuggggauggaucuguuuucaaaucagaaggggcuuauuuugggaacuauuuuacuuauuauucuauucaagaaggaucaggaaagguaagccaacaaugaacucaacucaagaagaguuuugcuguauagcucuuucuaaauaauuccaaauauauaugggaaauuuggucauuauauaacauugcuuccuacuccccagucuggaguauuaauauaaucuuacugccagcauugguacaguaauuauuaaccaccuuauuuuuacuguauuuucaccugcuaucuccauuugccuaagcaguucauguuuaaaucagaaacuuucuuuugucauagacuuuauugauggaaaaugcugaaaccaggacuuugaguuaauacacuacuuugaauuaauauuuguacauuaaaaagcaaaagcacauucuuuuuuccccaccauguaauuguguauuuuaagcaccucuuaacuucuaaaucuuuauauacaacuagacaguugaauaagauuguucucuguugcugaaaacagugaaacauaacaugguauaauuaccagcccauagucuuaauaaugucaauauuuuguuaaugaguuuuaauuugcuuauugccccucugauauuugacaucuaccauuucacagcaaucacuauaguaucacacuacuuugcaugcuagaacaaaauaaguauguuuucucucuucauuacagaguggaguauuuaaauacuaaucagauuaucagaaucccuagggaauagaguuaaaaauugagauuuuuuuaacuauggaaauuucaaacauauacaaaaguagacaaauauaagggaccccuauguacccaucacccaucuuguucauuuauacuuccugcuucucccuccacucccuguuuauuuuuaaguaaaucccaaccaaauauuguuuucuucauaaauacuucaguauauauuggaacagauucccaacuggggccuauuucuaggaaaauauuuaguaaauacauauuaauugaacaguaacucuuuggcaggcauucugguaagcacugacaaggaugaagaugaagaagaguuccugcccucaagaguucacagucuuguguucaguuagacaggcaaacaagcaaaugagauacaagcaugcccaguaacauguauacguauauauguguguauguguguuuauauaguacaucagacaaucaagugagcaagcaaauagaguagguaugcauagucauauugcugacugcuguauaucagagggugugcaaaauugcaagauaaaaggagugugucuuccuggagcuucaauuuuacucaaagcuguugcgggagggggugauaauuuuuauacuaaagcaaauauaucauggaguagaagcaugagcuuuuggguuaaaacgcauuugugguggacugccuugggcuucacucuccaaccuuugugugcaacaccuucaccuuucucugucuguuuuagugcaaagguuuagaaacaauugacccucuuuuggggauaaaguuguuugcuccuuacuuuaacccagacuccaaaauaaauuucagaugaauuaaagagcuaaauguaagaaaccaaacuuuauaaguguuagaagaaaauauagaagaacaauguuuaaaaucucuggguaaaggaggccuuguuaaguagaauacagaaaaccagaaggcauaaaagaaaaguuugacaagcuugaaaucuucaaacuuacguuaaauuauaaauauuuaggcugggcacaguggcuuaugccuguaaucacagcacuuugggaggccaaggcugguggaucacaugaggccaggaguucgagacaagcccagccaacauggcaaaaccucgucucuacugaaaauacaaaaauuagccaggcaugguggugcuuguguguaaucccagcuacuugggagacugaggcaugagaaucgcuugaaccugggagguggagguugcagugagccaagaucacaccacugcacaccagucuaggagacagagcaagacucugucucaaaaaaauuuuuuuaauuaaaagaaaauuuuagaauuucuguuaaaaagauaagcaaaagcccagaagauauuccacacuauaaaucaguaauagaccaaaaaaccaaaauacccuaauagaaaaaugggcaaaggguaaaaauggauuuagccauagaaaagauaauguaaauuaaaaagucauaauauuugaaaacauauucaacuuuacuacuugcaucagggaaaugcaaauuaaaauaucaaugacauaacauuuuucccuuaccaaauugccaauaacuaaaaagacugaugacaucugcugggaagggugugggaaaaguggugcuuucauaguguugguugaaguguuaauugguuuggcuuucuuaaaggacaauuugauaacaucaaaugaaauugaugagaaauucugcuucucaguaucuagccuagagaaauauuugcacguguucaaagaagcacggccaaggguguguuuuguggcauuauuuguagcagcaaaaaaucagaagcaaccuaaauaaauguucauuaauagggaaauggugaaauaaguuguaauuaucaaauuaugggaaugguguacaguaguugaaaagaaugagguagaugucgaugcauacaguaauagauucuggaagaucucaaagaucggguuguugagcgaauaaagaaacuugcguuagaacacguacaaugauaucuuuuguguaaagaacaaaaaauaaacccauaccuauauaguacuuucuguaauacacaugcacaagcacaaguaaggauccugggcaaauacacacugaaguagcuauguuugggaaagagugugggauuuugugagggaggagaagucugagaggacucaauuuucauacuuuuugaacuuuuuuuaacaaaaacuuaauguauuauuuauuguauaauuaaaaauugaaauaggaaagauugacaaguacucacaguguaaguacuuccauagagauaagaacuuggugcuuugggaccacauaagaaagggcaccagacccaguguuugaggcuccagaaacaacuccugaaggaaaacuuggcuaagcuaggaucuauaauuccaaaggaggaguuguacaaaagacagauggagguaggaggagcauauagcuaagggaacaauuuacuuucucaauuguuugcauggcuggcuucuugucacucagauuucuaucuaaaugucaucuccucacagacgcuuuuccugacuauucaaauuaaagaagcuacccaagacacucccuaucaugacauccucauguuuuuucuucaaagcacugaauauugggugacauuuucuuaaugauguauguucuuuaucagcuacacuagauuuaagcccuaucuuauucaacacauuauuauugcugcuucuuagcacaguuuauaaauggcaccuaacuggacacaagagccuggggcgaguguggaguguugaaggaagugaaaauguuguaguuugguaggccaaaacauagaugggaugcugggggaaauguccagagaagaagccagaucacuaagauggccagcucacaacuggagcaugaguaaccucacugcauuuggggaaccauugaaugauuucaaguagggaagugacaucagauuuuuguuagauuauuucagaggaagaugaacuggguggggaagagguaaaacuugaagcuguagaaccagucagaagacauguauaguaguucaagugaaggccaggcagugguaggaaaaaugagaaggaauauuaaggagacagaauugauugcugacuggacgcugaggaugaggaaggaguugaaagggaugccaaauuauuaaucaaugaaugguggugcccgguacugugugaaaccaaaauuuuuaucaaaucuaaauuuuuuugaugauggcuuuuuuuucuuuugcgccuaccaugagaugucaauuaaggauuugagauuauuaaaauucaacuauaucucaaccccaccugccuaauagauuauaagacacucuuaauuguaagauggauccagauuucagagagguuaaauugugaaaaaugagcauuuuagaguugaugaaauagggucuuggaaauaagaacccagagggaacucaauauccaguagagaaagacauaaauaauuaaaauaugguauuuugagugcuucccaugugcuaagcacugugcuaauaaaugauaaugauacagacaugagcaaaacagacacagccccuuccuucauggagcugcauucuaacagggaaaacagacauuaaguaaaaaacuauuaaauugaaguuguaauuaagaccaagaggcaggauuagagggaacugugcuuguggacauaacuaggggauuucuccuagucuaugagaccucugcaauggcuucccugagacggaaggaaaaacagguguuagcuaggcaaagggaggugcuggaggagggaacugaguucuagguagagggaacaacgugauaaaugacauaccaaagguaaauacagcguagagaaagugaaagugcaaauuuugaaaugacgcuaauuccaguuuuaacauggugauguugaggugucuguuuucauagccaaaagagaagcccaauagagauuuagauagucaggucuguagaccaagauaaaaggacaaagacuuuuguuugguaccuauuauaugcuaaauucugucccaggaacuucauauguauauuauaucauuaauccucagauaagucuggaugguaggcaguauccccauuucacaggcugcaggcacugaggcuuacaaaagguuguauagccugcccaucauuauaguugguaagaggcagacuugugauuugaauccacaucugucugacuuugaagccccucuucuuccccuaaugguaaagaguaugagcugcacucucuuggugguuuaaaucagaucucuacuguuucuuagcccucagucucaguuuucucaucugaagaacaagcauuaauaguuaucucagaauuauuuugaggaauaaaugagauaauccauguaaagugaguaggauagugccuagcgcauaguaucugcuccacaaauguuagcuguugcuauuaugauauuuaaugugaacacagcuuuggacccuuuuaguauuaucuaaaaagaaaucaagaagucagaagagaaggcuggagacagagugcugggaaacacuagcaagucugaggaggaggaaacucagaaagaauuuuaaaauaacaauuuuuuucaaauuucaguaaccuccgccuguaaauaauuuuuucuuccacaaacuguagcaguauuucuuccauuaauguagcaaaaugguauauucauucaauuaaaauaguuuuuuuaaaucuauauauccaugucuuuuugucuuaagggaaagggguggcucaugauaaauuuccugcuaauguguaggaaaauuaguuugguuaccauguuaauguaaauguagcuaauauuuaaauugcacaauaaguuauuagaauguaacuuuugggccaggcacaguggcucaugccuguaaucucagcacuuugggaucccuugagcccaggaguuugagacuagucuggguaauauaguaagaccucgccucuacaaaaaaacuuaaaaaauuagcccgguaugguggcaugugccugugguccuggcuacuugggaggcugaggugggaagacuccuugagccacagaggcugcagugagcuguaauugcgccacuguacuccagcccugggcaacagaguaaaacccugucuccaaaaaaaaaaaaaaaaaaaaaaauuaaaaaaaacuuuugaaugaauaggaguaauucuauauuuuuaaaaaaugggaaaauggcuuuuuuuucccacaauggguuugccaccagaacacagguguugugaaaacuaccccuaaaagccaaaaugggaaaggaaaagacucauaucaacauugucgucauuggacacguaaauucgggcaaguccaccacuacuggccaucugaccuacaaaugugguggcaucgacaaaagaaccauugaaaaauuugagaaggaggcugcugagaugggaaaggacuccuucaaguaugccugggucuugcauaaacugaaagcugagcgugaacgugguaucaccauugauaucuccuuguggaaauuugagaccagcaaguacuaugugacuaucauugaugccccaggacucagagacuucaucaaaaacaugauuacagggacaucucaggcugugcuguccugaugguugcugcugguguuggcgaauuugaaacugguaucuccaagaaugggcagaccugagagcaugcccuucuggcuuacacacugggugugaaacaacuaauuguugguguuaacaaaauggauuccacugagccacccuacagccagaagagagaagaggaaauuguuaaggaagucagcacuuacauuaagaaaauugguuacaacccugacacaguagcauuugugccaauuucugguuggaauggugacaacaugcuggagccgagugcuaacaugccuuggcucaagggauggaaagccacccguaaggauggcagugccagcggcaccaugcugcuugaggcucuggacugcauccuaccaccaacucauccaacugacaagcccuugcgccugccucuccaggaugucuacaaaauuggugguauugguacuguuccuguuggccgaguggagacugguguucucaaaccuggugugguggucaccuuugcuccagucaacauuacaacagaaguaaaaucugucgaaaugcaccaugaagcuuugagugaagcucuuccuggggacaaugugggcuucaaugucaagaaugugucugucaaggauguucgucguggcaacguugcuggugacagcaaaaaugacccaccaauggaaacagcugacuucauugcucagguaauuauccugaaccauccaggccaaauaagcgcuggcuaugccccuauauuggauugccacgcggcucacauugcaugcaaguuugcugagcugaaggaaaagauugaucgcgguucugguaaaaagcuggaagauggcccuaaauucuugaagucuggugaugcugccauuguugauaugguuccuggcaagcccauuguugagagcuucucagacuauccaccuuugggucauuuugcuguucgugauaugagacagacaguugcggugggugucaucaaagcaguggacaagaaggcugcuggagguggcaaggucacgaagucugcccagacagcucagaaggcuaaaugaauauuaucccuaauaccugccacccaacucuuaaucagugguggaagaauggucucagaacuguuuguuucaauuggccauuuaaguuuaguagugaaagacugguuaaugauaacaaugcaucguaaaaccuucagaaggaaaggagaauguuuuguggaccacuuugguuuucuuuuuugcaugugguaguuuuaaguuauuaguuuuuaaaaucaguacuuuuuaauggaaacaacuugaccaaaaauuugucacagaauuuugagaccuguuaaaaaaguuuaaugagaaaaaaaaaaugggaaaaugaaaaagcaucauaaaauaccaugauuuugugggcuuuauuuuguuaaaauaacuacucgucuugucacuauuguaaaaacauauuucaaggaaaagcagcuaaguaauaaaggccaaaauuuauuauuaaugaaauuuuucauuuuaacuaauuuucagagagaagagaaaacuuacucaguaaauaaccuuccuccagauagaccgggaaguccauucacugucgguucucuaauuaaacaggcaacaagguaaguucuucccauucaauugaaucaaauguuaugugucuaaacaucuuggcacauuuucuugugauuaaggauaagauuaagaauuggcagguacaauggaaauauaugccuucgguaaaauuugucaacuuuuuuggugucauaauuuauaaaauaagguaauuuuugugucauuuauuaagauuacuucuggcuuuguaauuuaaauauggagaaauauccauauauggugagcaagugcugagaggaaguaagugcccuuucuuugcauaaguguggcaucauuauuguuccuugaaaucaaguuggagauuugauguuacauuuaaaauuuuuauacuucuuuauuaucuucagaguaauagauuucugaaaauauacuaaugauaaagcauagauugguucuuugguucauauguuuuuaaaauucucucaaucuaugauacccagaagaaugcaaguggacuguuguuucuuuuuauaaauuuauguacaagcaauuuccaaaauagauuugaagaagcauauucuguaauuugauuuccuagggauaguugauucacaucccuaccauuuuuagccuaugugaaacuuuccaggcagugugaaucuaucaccucuuaaaaaaggaguuccugaaaauucuguccauggaaucauuucauugcuaaaaauuaaaggaauagccuuaaguagguaagauuagcacaaagggaagcaacaguauuucccuucuaggggcuuaaggauuucuggagaaaaaaagaguucccaacacauuucagugaaaaugauuuacugaucaucuaaaauguuguauggcagugaaaauggguugcuagaauuggaaaaugucauuugcaaauguuuaaguaguauuuuuuguguucacagaauucuucaacauugugugaagaugagacuuucuuuaagccauaacuaucguauaugcugcuggaaaaugguauguuaaaauuauuuuaaaagcaagauauuuuuaaauuguuuuauuguuuauauccauacuucugaguucaaacaguuuuccucuaagucaugugagaaauucuuguaacauuaauguugguuuauucagaaaaauaccuaccuaguagacaaacacugaaaguucaggcuuuuauguuauaguuuuauuguauaugguucuuauuuuucaugaagaggaaaggauaggggaacugauuggauuugaaguauguaaaaucauuagucauuauaaaccaugauauuauaguguucuauauuuucauaaccguaaaaauaaauuccuuaaugcugauuuggaggaagugauucucagacuuugauuucuguaucuauauucauuuaauuacaaaccuguaagcuccuaauuuuugucuauaauggauguaaaguucagagcagaacagugacuuuacaaauauauuauaacugaaucugcuugaaaaaaagacuguuuuggguauccacuucuggaaaaauuaaaauauaaggauuuuauaauauuugacuucugaauaaguauccaaaauugcccuagagucauuaauauucauuuaaaucuuguucuuagauaacucuauuuccugcuauuuuuauuuacuugguuuuagguaccugggauaaacgauagcaauauacugccuuugguuuugaaagagucacucauacccagugugggaagauuucuugccuacucugaugacaaaguacaugcuaucuuuuuagauggcauuacucuaacccuaaauuggaauuucagcucuccuauugagaagagacagguggguauacuucagacuuagaucuauuuuuuauugguaaucuguggaaaacagaacaaagaaaacaaaguaccacacuauuucaguucauuuuuugaaguauaaaaucugucaagaagcuuuacugaucucuuuggauuuccuagcaaaaaucagaaugauuugacaaauagucacuuuucuaaagauaacugauuauagagaaagggauuaguauuuucauuugcuuugauaauuaccuauaugaguggugguuaaauaacacccauaucucauguaaacaacauuuaaacuguugcaucuuuaaugauuccucuacuuauuucuuuaaguuaaugaaguuagaauagguuguuuauguucuuuuuuucaguucuaaaaugauaaaacuuaucuuucuacuucuucagguaaaucaaggucuuaacuuagguugguguaaguuaacuuuuccugauggacaagagcaguuaauucagauugaacacccugaaccauaugaaagguacugaaaagcaauuuuaaaaauuauuuuuauguuuuacuuuuaacuaacagagaauaagcaauaagcauuauuuaaguguuauauauauuuuuaguuuuuccauguggauaauaaugaaggcauuucagucguuucagaguugauagcuguacuuguguuuagcauaacuaaauagaucaagucagcuuuuuuuuuuuuuuuuuuuuugagacagaguuuugcuccuguggccugggccggaguacaauggcacgaucucggcucaccacaaccuccgccuccuggguucaagcgauucuccugccucagccuccugaguagcugggauuacaggcaugugccaccaugcccggcuaauuuuuguauuuuuaguagagaugggguuucuccauguuggucaggcuugucuugaacucccgaccucaggugaucugcccaccuuggccucccaaagugcugagauuacaggcaugagccaccaugcccggccuucaggucagcuuuaaucauuucauuuguauucaaguaacuuuucaaaaugaaauguguuauagacauacugauuugcuguggagguuggauauggucagcuguguuaacaauuaacuaauccucuagccaauuugaaauaagauuugcaaccacaaauaacugaaauucuguauauuucuauaaaguggauaaaauuacgcaaugauuaucuuaaaauggggaagagucuucagcuuuuuaugaauuuuuuuucuuuugguuuaucuaauuuauuacaguaaaucuugugauagucuucacauuuuagugauuucacuugagaauauucacaaaauaauagcuuuuuguuaccucuugaauguauuuuucuguuggguuuuauuguguuucagucuaagugcucauucauugcuauuaaugauuugccucaaaaaagauaguuucuuuagcaaacauuucuauugauucagccaaucauuucagaucauucauuuuauuaaacuugauacuuguuuuagauauguaguaaguuacauauaauuacacauaugcauacaagcauauguguauaugcauuagcagguguuuuuugguuuaaauuuuaguaagcaaaugcucagucagucuuauuuugugugaauauuuuuugauaaaacuuaaacgcauuuuacuuugaaaaacuaaaagaauuagaacauuuaaaauugaacuuuaaaugaaauccaaauaucgccuuuauuuugauucuuaaaugucacuuguauuaaucacaaauauaaguaaaucauuuuauucuugaugaauaauggaaaaaauuuggcuuuucuaugaccagugaaaaauauuuugagaauugcccaguaaaugcuucacuuuaacauuuuuucuuuauccuuuuuucccaaauugucuuauuuuuacauuuguuuauaauuuuauaauguauucaaguucauuuuucaaguauuucuuuuaauguauucacuuuagauaugugacaacaguaacaucauggugcaggagacugacccagacuagucccagagagaugcccacucauucgucaucuucuguucuccaagaaaauugguauuuuucuuuuaaacuuaaaucuguuuagaagagcuaauacuuuaaaaaaaauuaaaaugucaaaugguaaacugagacuuuuuuccccaaaaaaacuuucuuaguuuugaauauguuuaacuccuaaaguauuuuugauagcuuaagcuugaaaauaauuucuaaucagacaucuaauuuauuacauuucaucauauucuauuuuaccuaaagguaagaaaaccuugcauugaaaacuuaacaugaaaaugaguggcucuuuuuaugugacaaauucauccugaaaacuuuauggaaaaauuuaaaggggauucuuaaauuuuuaguaauguugaaggaaauaaaagguuuaauaacauaagcuuucagaaaacauugauuuuuaaauaauuucugucauauuaguuacuucucccaaauuaacuggcagaucaaauaaagcaaguauuuuagucccuccugugugcuuuucagugugcaggguacuagaacugggcuucaagggaacuuucugugaaaauauaagacauuuuagggaggaaauaagggcagaaguaaaaaggauauuuuagccuguggagauagaagauaguuuuuauggaacauaugcuaucuauuaguauauaguaugaguuuugagggcuaggaauggaucuuauaauaaauaggaguucagaccugauggaauuagaaaguccuaaauggaaaaaugauaggaagaaaggucauuagaagauuagugucacugagagucuaaccugaauauaugggaagacagggauaccaggaacaauuugggaagcuuuuuaaguaaguuuugugaggugaccuaacauaguguagugaaacaaaauguaaacauuaagccaauuuuuguuaccuuuuccuaagcccuuucuuagaacaaaucaaaucauaucaguaagcguuauuugaauaucucagguagcuuaaggauccagcuuugcagaucccucauccuuuagcuguagccuguuuggaagcagaaaaguugcuaaaguaacuagcaaaaaacaauugugauggaaggaaaauuguacuugucuauaaaaccaucacuucaccauugcuuagcuggcaguuuguaaaauaucaucagccuuuuuauuugaaagcugagaagaggcugucaauacacacuaaaaacugcaaguagagauuggugauaguagcuaaaggugaaagcaacuaggaacagcagaggcaagauaaagaaauugaggaguagcuccauucccccuauaaagccuuagguaucuccacuucgguuuuucuuaucaaagaggguagguugaaggaagaaacaagauuguacaauaaaaagcuaccuaaguuguauucuaguauuuuuuuuccgccacacccuccauuauuagcuuauuaauucaacuuuuuagucaacaaauaguacguuucauaaaaaguucguucauuaugagagcaauaacaauaaagguuguauuguuucuuacauccagaaaaaugcguuggguuuaaaaaaaaaaagauauuuugcaauaaugaacaaucagcugguuguugggguaaguuguauccaaguucuuugccacagguguuuaaaauuaugaaauauuucuuuucauucuccauccauaggcuggaguacaagggaaagaguacaagcugacagggaggugcaugugaucuguuguaguaaagccaauaaagcagacaagucacacaaccuacuacgaacugugaagauuuuucuggugacuugaauauuuuagacuaaugucuucauuaauuuugcagagagcuagucaaguuacaguuuguaguuguaugccauugcucauauuucauucuaacuugauaagaaaaaggauaaagaacacacacuuagggguucugcuggagacguauauauuagcccucuacuccauaccaguugucccacuaucuuucuauagaacaugguauaagagcuaauguucaucauguuaacccucugugcuuaaaaaaacaaugaaauaaguagguagucuauuccagaaagaauuuaauaaaaaauaguuguuuugacacguaauucaacuauuuaaaaacuuggaucucccauaccauccauucccaaagaguuccauauaaaugaggucuuaauauaugcacaaguacagaaaaguaaaaaauccuuucuucugagagaaacaaucuagguaggaagagcaggaaguuaaauaguucaagagaagauauuacaaauaaguaugugauuaauuaauaugcuauaggaauucaaggaaggagagagcaguucuuucacagaaggaaugggauuuuaauagguuuguaaaguuugcguaaacuuuagggaggaaaguagaguguaagcuagguuaguacuaagaaguaacaggaaggcccauuauccucaaacaucaauauuugauuacaaauuccuugaaguggauuuacaagggguagacuuuuauucacuuaccuuuaaaggcacucaguaaguaucaguugagucaaguugauuuguugcuaaauaaagguaacauaaagagaauucuucugcguucuuccguuuaaaauucuaaugaaaaaaaaagucagguaugcuuauuugaaauaucaugaauacaaaagaaucagacaacugaaugaauuuuuucuuuuuccuuggacaggucuguugcuucugaacuugaaaagauacagaaguuuaacuguauccuuuaaacagaaugcacuguccuacauaauuacucucuuucauucuaggcuuaauucaugacuucaguacuuugugaauauuaaucuauacuuaauauauugcuaaccuuuauugagucagcaaauaccuaagauuguaauuuaagauggaucuuguccauagaagguauagcauguuaacauuuauacuuuucuuugaguuuaaauugggcaaagaacaguuaauuaggguuaaggucuccuuuggagacuuuuucacuuacauaauuauauaauaaaauuauaacuguuuaagaccucuuuuuuuaaaugaaauauuucauucuguacauucucacccaauucaucuaaauuuguuuucucuugugguuuuucucuaaucuuauucaaauaaguuaguucuauagcgaacagguuuuucacucuaaaucuuuuuaaauuaaaaauagacacuacacagauuccuuauaauccugucauccuacucuuuaauucccgugucauuucuucacuuaaagaaauguuacugaaauuuucauuuccuccuuaccaccaaaccuccacccaaacacacacauacacacucuauucucuuucccccucccuuauacuguaauuaguuucuucaucuacaaggagcagacuugauaagccuugcaguuccaacuguauuaugaauccaagaggucuuccagcugagaaauauuuuaauaugaagccuaugcuuucuguauauaaagauauuuauauagugaaaaauguggggaaaaccuccuuaacuaagcaacuuagugcuacuagaaaauagugguauccuaaaccagauuucuaacaagaaaaaugaacaacagucuuuugaucauuauaaaccaggaucuucagaaaccuugcuaggagaaguuaaugaaaauagaguaucaauagcauugaaaaaaaccucugaaauccuucacgauauugacugucuucuaucaaacucuaaaaagugaaaaauggaauuauuacaacauauuauuaaaguuuaaggauguuguuucaagugacugguauaaaauuacuaguaagccaagauauuguacguauuaccccggcacaaugauugugaaagaacugacauuuaacuuugaagguauuuuuaacuuguacauuuuuaaaauauguauuuauaucuuaauaauaaauauuucgaaguuuugaacguuu

SEQ ID NO: 192460 - RNA, 13949 nt, Homo sapiens
auauccgccugggcgucacgcuucguggggcgggacgaggagaagccaaacguaaagacaccaggaguuucucgggcccagcuguggcugcugccggggagccccaagccuuggcggguccuugcggcgaauaggagucuggucaggcgucaggcuaguccgacgaagaguggguagguggaagccuuccaaagagcggcgguugucugggagccgucucaguuggccgcgacccgggcgcaugcgcggggcgggcggugcgccuuggguagcuuguccucuccgaccccgggcgcugagggccucuguacggcgccgcguagggucucggccgcagaacguggccgagaggcccgggcgagacuucgggaccguguccugagcgcucuccaugcgcccggcgcgaggugagcgcuaaauagugguuguugaaaaauauugaaagccacccaagugcucagcaguaaggauauugagcuuuuuaaagugauugauuuaguccaaaaauuguacgucgcacgcccacugugcacgacccaguguuuuagggccuugggaaacagcagugaacaagauagcaagauucuuggaguggacuuuuguugggguggggaggggaaguacagauaaagauaaacgaguuacauaauugucauagaaaaaggcaaaugcuacgaagaagaaagcagggacggggcauggggguggggugcgguguuagccgagaagggcacugggccaacccgauugagauuugagcuaagccaggaagggggcaagggugugaguccgguggcugccuggaggaagaucuuucccagcauggggaaaagcuagagccgaggcccagcggugggagcgagacuggcgcgugagaaagagcuaggcuaggccugugugguggcggggauugagcggagggagaauggcaggacaugaagucagagguguagagggagcaguccugcaggugaggcagagccuugcaggcugcucuaaggacuuuggccuuacucuggauaaaacgggaaccauagcaagauuuugagcagaggaaugauguagcuugaguagauguuaauagacucacuggccgccguagggauggagaagcgggggaguagggagaaucagauuuauuacuaauaggucagauuaggagcaucccugcgcagccacuaaaaaaggcugacucuaggccgggcgcgguggcucaugccuguaaucccagcacuuugagggggccgaggucggcggaucacuugacgccaggaguucgagaccagccugggccaacauggcgaaaccccauuuguacuaaaaauacaaaaguuagcugggcgugaugacguacgccuguaaucccagcuacucaggagacugaggagcgagaauugcuucgacccaaagcacuccagccugggcgacagagugagacuccaucucaaaacaaacaacaagacugacuuuaaagaugacgaugacaguaacuucgugagcccacaucuguggagagccuggugaauauauuuaauaccagucuguacaaaauaauuucccagguauccucuccuuuaaugucagaacagccugcagagggcagugcugucauuuguaagucuuuuuuuuuuuuuuuaauugcaaaaaauacgugacauaaaauuuaucguaaguagcauugaguacauucacaacgcugugcagccaucaccacuguccaucucgugaauguuguguaagucuucguuuuacuggcaucuaagcccugggucuaauuucacuccccuauuuuaggcagccagcuccaucaaggcaguaacacuaaaaaacauuuaugugccaagcaaugaaagaaacagaugagguuucuuguucucccugcccuucuaguuaggggagacucuagugacugggaaagaagcaucagguaacuauuuccgcuguccugaaaccaaggauucuuuugaauauauaggccuauaccacuaucacuuuucucucauuugaauaccuacuuugugucauaguauuacaguauuuuuuguuuguuuguuuuggagacagggucaugcucugucacccaggcuggagugcagugguacaaucacagugcacuguauccuuaaccucccagacucaagcuauccucccaccucagccccuggaguagcugggacuacaggcacacacuaccaugccugguuaauuuaaguuuuuuuguuuuuuuuuuuagugacagggucucacuauguuucccaggcuggucucaaacuccuggccucccaaacuguugagauuacaggcaugagcaccacgccaggccccaaaguauuaauguuuguugaauggauugguagauguagcuccuugacccugacuucuuuucuccagaggucaucaucugggagugguuggaacugggucuaacccagagugguuuugaaaugcugguccauagcucugugaccuuggauaagucccuuuccuugauugggccucaguuuccuguucccuguagugggggauccauauauuaaacaaauagacaguguuaagagauugcauaacaugggggcuuaacuuagagaagggugucagagaagaccuucaugaagaggugguauuuaaacugaaaguugaaggaugaauaggaccuauccagagggagagcaagguuggcauggagccaaggaaaggaacugucuacagagagaugagcauguucuacguucuugaaaguucagaccuuuuagaagcugcauugagugccccuuccaggaaucccucuucucaaccccugugcuguuuaagcucaguuguucacagauagucuugcacagaccuggcuuuuggacugagagcaggcagacacaggaugggaggagacggcagaacgaccaucccucauucuucucuuuguguucuguguugacugagaguaaacaagaagaggaccuucaaaucuuagauuuuacuccuuuaugucuuuucuuuuucuuuggauaaagaggcaucguaacuggucuugagugggcucagagugguuggaaucucugggcacccuugggcagauguuaccuacguuuacuaaaccucugugucaucuucucgaaaaugggaauaauaauaccucuuaccucaggagcauuuugaagacaagcuaaggcaugugaaauguuuagcaaagagcugggugcucauaaggaaaauuguuagccaaaauuauguuguuauguuuuaaguaagaguacagugauuugacauuuauagaauauagaaacuuauuuuguauucguauggguaaccuuaguuugaucagaauuagaugaguuacugugcucagaagucuuaaaaaccaaacaggaggccaggcacaguggcucacaccuguaauaccggcacucugggaggccgaggcaggcguaucacgaggucaggaguucgagaccagccugaccaauauggugaaacccugucucuacuaaaaauacaaaaaagguagccgggcgugguagcacauuccuauaaucccagcuacucgggaggcugaggcaggagaauugcuugaauccgcgaggcagagguugcagugagccaagauugugccacugcacuccagccugggcgacagagcaagacuccuucuccaaaaaaaaaauaauaauaacaggaaggccgggccugguggcucacacuuguaaucccagcacuuugggaggcugaguugggcaaauugcuugagcccaggaguuugaaaccagccugggcaacauggugaaacccugucucuacaaaaaauacaaaaaucugcuggaugugguggcacgugccuauacucccagcuacucaggagucugaggcaggaggaucaccugagccucgagagccagagguggaggcugcagugaacucugauuguaccacugcacuucagccuaggugacagggugagacccugccuuaaaacaaacaaacaaaaaaaacccaaauaggccaaauucucaucaaaacucugaaaaauagcaugugcauuggucauuucuagcccucuugacuuacuguaggugugaucagcacuggaaaagaugccugccccugcugccacauaugaaagaguaguuuacaaaaacccuuccgaguaccacuacaugaaagucugccuguaaguuuaguuuccuaaguucuauuuuagauuacuuuucuaacaugaaucugaauagaaugaaauuuaauaugacuuuuuuuuuuuucacuuuuuuuagagaauuucaagauuguggaguuggacugaaugcugcacaguucaaacagcugcuuauuucggcugugaaggaccuguuuggggagguauggaaucacuugguagauugaacauuccaaagaucuuuguaagaaauacagaaagaggccgggcgcgguagcucacgccuguaaucccagcacuuuggaggccgaggugggcagaucaugaggucaagagaucgagaccauccuggccaacauggugaaaccccaucuguacuaaaacugcaaagauaagcugggugugguggcaggcaccuguaaucccagcuacucgggaggcugaggcaggauaauugcuugaacccgggaggcagagguugcagugagccgagauaacgccacugcacuccagccuggcaacagagcgagacucugucacaaaaaaaaaaaucgagaaagaaugcuuuucaaacaucaaaaaaaaaaaaaaaauaaauuauacaacucuguauuuuuaaauuuuuauucauuuauuguaauaaacacauuuguauuccuuuuuuuccuccuucauccucucuacccuccuacccuucccagccucugauaaucaccaaucuacuuucuauccucaugaaaucuacuuuuuguuguuguuguuguuguuguuguuguuuuucuuugagauggagucuugcuuuguugcccaggcuggagugcaauggcacauucuuggcucacugcagccucugccucccagauucaagggaucuuccugccuuagccccccugguagcugagauuacaggcacacgcuaccaugcccaacuaauuuuuguauuuuuacuagagacaggguuucgucauguuggccaggcuggucuugaacuccugaccucaggugauccacgcgccuugggcucccaaagugcuggauuacaggcacgagccacugugccuggcaagaucugcuuuuuuagcucucacauaugagugagaacaugcaacaguugucuuucugugccuggcuggcuucacuuaacaaaauggccuccaguucuauucaugaugcugcaaaugacagaauuucauucuuuuuuauggcugaauaauauuccauuguaauauauaccacuuuuuuuuuuuuauccauugaugggcacuuaaguucuacauuuugccuauugggaauacaauaaauaugagagugcauauguccuuuuuuuuuuuuuuccccaccuuggcuucccaaagugcugggaugacagcaugagccacuaugcccagcugcacaugucuuuuugaauugauuuccuuucucuuggauuuaugcucaguaguagacuugcuggauuaaaugguauucuauuuuuaguuuaguuucuuuuguuuuuuguuuuugagaugaagucuugccgugaugcccaggguggagugcaguggcauggucauggcucacuacagccucaaccucccaagcucaagugauucucccaccucaguaucccgaguagcugggaccacaggcgugugccaccacgccaauuuuuuuacuuguagaggcaaggucucacuauguugcccaggcuccuggacucaagcaauccuccugccuuggccucccaaagcacugggauuacagacaugagccacugcaccugaccuauuuuuaguuuuuugggaaaccuccauacugcucuccacagugguuguacauuuacauuccucccaguagugugugaggguuccccuagagauuauuuuauuuuauuuuuauuuauuuauuuuuugagacagagucucgcucugucacccaggcuggagugcaguggcacaaccuccgcacccccccccgccccucccggauucaagugauucuccugccucagccucccgaguagcugagacuacagguaccugccaccacgcccagcuaauuuuuguauuccccuagagauuauuuuaaaacuguguuugaaauugcagaaguaaacuuucagaagugaugaauuuuguuggguuuauucuaauaugccuucuguuugacaaggaacacguuagacaaaugauuguuguagcacagugcuacucaaaguguggccuagacuggcaccugcaaacucuuuucccaucuugaagagauaaggaauuugcagcagaaccacuuuuaaugagaaagucuccuuaugggccaggcgcaguggcucacuccuauaaucccagcucuucgggaggcugagaugagcagaucacuuacagucaggaguuugagacuagccuggccaacguggugaaacgcuuucucuacugaaaauacaaaaauuagcugggcaugguggcgcacgcuuguagucccagcuacuuggaagacugaggcaggagaauugcuugaaccugggaggcagagguugcagugagcagagaucacgccacugcauuccagccugggcaacagagcaagacucugucucaaaaaaaaaaaaaaaaaaaagggcugggcacgguagcucacgccuguaauccuagcacuuugggaggccaaggcaggcagaucccaaggucagccgaucaagaccauccuggcuaacacggugaaacccugucucuacuaaaaacacaaaaagccgggcgcagcggcgggcaccuguagucccagcuacucgggaggcugaggcaggagaauggcaugaacccgggagguggagcuugcagugagccgagaucacgccacugcacuccagccugggcgacagagcgagacucggucucaaaaaaaaggcuccucaugaaaaaaagaugaacugaacuaaacauggugauuaaugauacuauugguuuauauucugauucaacucauuauuuugucauagaccagcauuuuaagcaacuuugagaacagaaguagagaaguagaguuucagaaguugaaagaagacaggaugcucaggaaauuauuuugugauucauauagucugucaaaucaaaauaugcuaaguaccucaucaaaauuuaaaacuuuuacucugcaaaagacucuuaagaggaugaaagggccaggugcaguggcucacagcuguaaucccaccacuuuugagaggccaagcggguggaucacuugagcccaggaguuccaggccagccuggguaucuggugaaaccccaucucuacaaaacaauuugaaaaauugagcugggugugguggugugcacugauagucccaacuagucaggaggcugaggugggaggauugcuugagcccaagagcucaagguugcaaugaguggugaucacaccuccauggcuggggguaggggugggaaaggaugaaaagaugaauuacacacugggggaaaauauuuguaaaccacguauccaacaaaggacuauagugucuagaauauauaaaugacauuuggccuggugcaguggcucaugcccguaaucccaacacuuugggaagccagggcaggaagauugcuugaggccaggaguuugaggcuggcugugguaaacuaugauugcacuacugcacugcagccuggucaacagaacaagaccaugucucaaaaauaauaacacauggggcgugguggcucaugccuguaaucccagcacuuugggaggccgagguggguugauugccugaggucaggaguuugagaccauccuggccaacauggcaaaacccugucucugcuaaagcuauaaaaacuagccgggcgugguggcacaugccuguaaccccagcuacucgggagguuaaggcaggagaaccacuugaaccugggaggcggagguugcagugagcugagaucacaccacugcacuccagccagggugacagagagagacucugucucaaaaaaauaauaguaauaauaauaaaaaagaaguaucagaacucaaccaaacaauucaauuagaaaaugggcaaaaacauuaacagacauuuugcuaaagagaaugugugguuggcaaagaagcacauggaaagauguuuaacauuagccauuagggaaaugcacauuaaugacacaaugagauaccacuguguaccuagcagaaugacugaaauaaaaaaugacaacacuaagugcuagcaagaaugcaaagaaacuagaucacucauacacuacagugaguauguaaaauggugcagccacucuggaacauaguuuggcaguauuuuuuuuuuuuuuuuuuuuuuuuuguugagauggagucucguucugucaccgggcuggagugcaguggcacaaucuuggcucacugcaaccuccgccucccagguucaggcgauucuccugucucagccucccaaguagcuaggacuacaggcacacaccaccacacccagcuaauuuuuuuguauuuuuaguggagacgggguuucaccauguugaccaggauggucucaaucucuugaccuugugauccgccugccuuggccucccaaagugcugggauuacaggugugagccaccaugccuggccagcaguaucuuuaacaaacuaaacgugcaucugccauagaacccagcauuagcacuccugggcaucuguuccagaggacugaaaacuuaaguucacacaaaagccuguacaugaauauucauagcagcuuuauuuuuaauaacaaugaaacugaaaacaccccauauauccuucaaugggugaauaaacugugguacauuccuacuauggaauauacucgacagugaaaaggaaugaccuauuuagacacaauaugaaugaaucuccagagaauuaugcugagcgaaaaaaagccaaucccaaaacaugacauacuggguguuuccauuuauagaagacucuugaaauacuauauauaaucuggagaaagguuagugguugcuggggugaggaguaggggaggagggguggguguggcuguaaaggguagaauaagggagucuuaugaugguacaguucuuuaucauugauuguggugguaguuauaugaagcuaccuaugugggaaaauuacauagagccacacacagguauaaauaggaguagacauacaauugguaaaaucugaauaaccucugguuuguaccaauaccaguuuuguaguuuugcuacuguacuguaguuacgcaagacauugacauugugggaggcuggaugaagagugcaugaaccucccuguacauuucuuuuuuauuuauuuauuuauuuuugaaacagaguuucgcucuucuugcccaggcuggagugcaauggcacgaucuuggcucaccgcacccuccgccucccagguucaagcgauucuccugccucagccucgcaaguagcugggauuacaggcaugugccaccacacccggcuaauuuuguauuuuuaguaaaaaugggguuucuccguguugaucaggcuggucucaaacucccaaccucaggugauccgcccuccuuggccucccaaagugccgggauuacaggcgugagccacugugcccggccaaucccuguacauuucuuugugaucucuugugagucuauaauuuuuuuaaauacaaaauuuuaaaaaaaaauaucccuguguguaccugugugucagguagaaaaccucguuccugggguuuauauagcugcaaacaaacagacauggccucugccacauggacuaaugucuugguucuuguaguaggaaaacauguuggacaauuagugacaagaauaaagggaauuaugaaagagaaaguaugguguccuguacaagaaagaacauagcaagcugacuuugucucaucuugaagaucagucaaggaacaauuuaaaugaaggcucaaaggaugagagacaucagccauaugaagagguguaggcagaacauucuaggcagggggagcuguaaguaggcaacuaaagugccagcaccauuaaauaaaauacugcuuauguggaggagaaaagcucaaaacucauuuguugucaaaaguugacaagcauucaagaauaauggugagaauagccugcuaauagcauuauuccauaugcagguugaugccgccuuaccuuuggacauccuaaccuaugaagagaagaccuugucagccaucuugagaauauguagcagguaugacagagagugggaaauuucuaguauaacagggcagagagaccgauggagcaaaaaugcucucuucugagaaugagaauaaauuuuuuguugugaacucugagcagcuuuugggaauuuaaacugggaugaauaugaacauucauccaccagaaacuuguacucuagagagggcaaaacuuacgauuugguuacagcuguaguuuucccauugaugguuauaguugcaaagucagaagugaauauuuuagaaaccuuaguugaaguucauuuuguucucugucuaugacacacuauguauuuucuugaucuuucugcaguggucuugucaaauuguggagcucuuugacccuguuaggauccuauaaaggcaaaaaaugugcuuuccgggugauucagguaaagacuauucccucacauauuccaaacaagacugagugaugggucaacugcuucuuaauauacacaacucauuuuugugcuugcauaaauguaauaugguuaaaaugaucuaaguaggggaaaauaaaggacuugauuguuuccaaaaaugugagacagagcacuuagauuuuaaaaucuaugggagauguuuugggauaaaacuugcaacccugugguuaaggcuuacuuuuuuuauuuaacacuuaaugccuuguguguuauauauugguacgcucuuuuugagaugugaccacuuguuaucgaaggcuuccucucaggaugcucuguaaaaugcuccugcaucagcuuuguuuauccuguaaaacugggcauguuuccccauugcccugugcuucagugugguuucucccaaugccuuaaccuuuuucuuucucuucuagguuucuccauuucuucuugcauuaucugguaauaguagggaacuaguauuggauugaaugaauagucuuccauuuuggaaacguucauccacucucauauuuauuuuuuggugccugcauguuugaagacugaagcaggcuaaaagcucuugaugaaauuugagggugcugaagauguucccacuaauuuccagccaucaccuuugguggggugggcuucggaggacagucugucugaaccugccagugcugacccugcagcacuuucagcauaugcacaucaaaguuggagaccgcgcugaacuuaggagggccuucacacagacugauguggcuaccuucucagaauuaacaggggaugucaauccuuugcauuugaaugaagacuuugcaaaacacaccaaguuuggaaauacaauuguacauggaguuuugaucaacggacuuaucucagcucuccuaggaacuaaaaugccagggccaggcuguguauuucuuucccaggaaauuagcuuuccagccccuuuauauauuggagaaguuguuuuagcuucugcagaagugaaaaagcugaagcgguucauugcuauuauugcagugucauguucuguaauagaaaguaaaaagacuguuauggaaggcuggguuaaaguuaugguuccagaagcuuccaaauccugaaauagauguuuuaaagaugcaaccucaaacaccaaugcuguuguuaaagagccuauggggaauugcugcucuuuaccaaagaaugguugauaggcccagaagcccaucuuaguuaggggaagggagcaggaagaggguuguucaaaugcccacuuuccaguuuggccuuaugcuucaugcagacuugaguguaugcaggauuucauuaucugccuggguuuuuuguuuguuuuuuguuuuuuaauucaagaaguaggcugggcccgguggcucaugccuguaauccuggcacuuugggaggcugcggcaggcggaucacuugaggucaggaguccaagaccagccuggccaacauggugaaaccccaucucuaccaaaaaaaaaaaaaaaaaaaaagugcaacuagcugugcuuggugacuuggcccuguagucccaguugcuugggaggcugaggugggagaauugcuugggccugagagcuggagguuauggugagaaacugagauugcaccacugcacuguagccugagugacagagcgagacccugucucaagaaagaaguauugggaagguuauuuaaagacucuacuuuuaaaucaggcguggcagcucacgccuguaaucccagcauuuugggaggcugaggcaggcgaaucacuugaggucaggaguucaagaccagccuggccaacaugugaaaccccaucucuacuaaaaauacaaaaacuaaccgggcaugguggcgggcaccuguaaucccagcuacuugggaggcugaggcaggagaaucucuugaaccugggagguugcagugagcugaaaucacaccacugcacuucagccugggugacagagcaaaacuccaccucaaaaaaaaaaaaaagauucuacuuuuagaaauucagaccuagauagauuugcauuuggauaacaaaucccuaccuauagccauguggaagcagcuugucacuguauuuuaacuguguaacaauuauugaaggcgaaaauagaaguugggucaucuuugaacaccuaccuuuuaucaaugaauauuuuuagacuguucuucaguaucugagucagaguuuauuguaauuuguuauuuacaccaagguggcaucuuagucuaccuucagugagacuugcguuucaggggaggggcguaugugcauccucggucucaguuauguaaacggucugaucuguaaaauagugguagcacaugccaugugggauaguugguggagaugauagauggaguuaagcacagggcccagccugucagcaguagcuacuauuauuguugcccauuuccccugcaacugaggugagagguuuuccugaguuugaagcugacuggcccacaguuaaacguaacagaccaguuuuucagggugucagccaaccucuauuaguguucuuaaguacaguuucuguuauaaaaguucagauuauuccuugaaaauuuggaucuaccucccauuauuaugaguaauacaugcuuauaguaaaaaaaaaaaaauuguaagaaauaaauauuaagaagauuauggaggccaaauucuuaagacuuugggggcuggggucagggagguuauauugaaggggagaugugccuaacauguuacuacuaaauggccaucccaacacagccaacacuuuuguuucccauuuuuuuuuguuucccguuuuuuaauaaaauugagauauaauucacauaccauaaaauucaccuuuuaaaaguguacaguuuagugguuuucagaauauccacaaaguuguacaaccaucaccaaaucaauuuuuuauagcauuuuucaucacccccaaaagaaccucccauuagcagucaauccauuucucuccuccagucuuugggaaucaccagucuacuuucugucucuauggguuucccuguucuggacauuucauaaaaguucauacaauguaugauccuuuggaacuggcuucuuugauauagcauguuuucaggguucauccauguuacagcauguaucaguacaucauuuuauuuuauggcugaauaauauuccauuguauuuacccaua
